United States Patent 12,097,253 (RSV RNA MOLECULES AND COMPOSITIONS FOR VACCINATION) - sequence listing, part 10

SEQ ID NO: 13749 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut0 (opt1)
  source 1..1856: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13750 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut0 (opt2)
  source 1..1856: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13751 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut0 (opt3)
  source 1..1856: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13752 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut0 (opt4)
  source 1..1856: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13753 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut0 (opt5)
  source 1..1856: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13754 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut0 (opt6)
  source 1..1856: mol_type = other RNA
gggagacccgtgacccggaagttgtacggctacgcgactttccctcccacaaaccctcgcgcccttcctttcctacttgggcccggcagaaagcttaccatggaactcccaatacttaaaacaaacgcaatcacaacaatactagctgcagtcacactatgcttcgcctcatcacaaaatataacagaagaattttatcaatcaacatgctccgcagtatcaaaaggatatctctctgcattacgaacaggttggtacacctcggtaataacaatagaattatcaaacataaaagaaaataaatgcaatggaaccgatgccaaagtaaaactaatcaaacaagaacttgacaaatacaaaaacgcagtaacagaactacaactattaatgcaatcaacaccagcagcaggttcaggctccgcaatcgcttcaggaatagccgtttgtaaagtactacacttagaaggagaagtaaataaaataaaaaacgccttactatcaacaaacaaagcagtagtctccctttccaacggagtatcagtcttaacttttaaagtactcgacttaaaaaattacatcgacaaacaactactacccattctaaataaacaatcatgctcaatatcaaacatcgaaacagtaatcgaatttcaacaaaaaaataatagattactagaaataacacgagaattttccgtaaatgccggagtaacgaccccagtctcaacatacatgttaacaaactcagaattactatcactcattaacgatatgccaataacaaatgaccaaaaaaaactaatgtcaaacaacgtccaaatagtacgacaacaatcatactctatcatgtgtataataaaagaagaagttttagcatacgtagtacaactaccactttacggagtcatagacaccccatgctggaaactacacacatcacccttatgtacaacaaacaccaaagaagggtctaacatatgtctcactagaacagatcgaggctggtactgcgacaacgcaggatcagttagctttttccctcaagccgaaacctgtaaagtacaatccaatcgagtattttgcgacactatgaactctagaaccttaccctccgaagtaaacctatgtaacatagacatatttaatcccaaatatgattgcaaaatcatgacatccaaaacagatgtatcaagctctgtaataacctcactaggagcaatagtttcatgctatggtaaaacaaaatgcaccgcctcaaacaaaaatagagggataatcaaaaccttctcaaatggatgcgactacgtatcaaataaaggagtagacaccgtctccgtaggaaacacactatactacgtaaacaaacaagaaggaaaatcactatacgtaaaaggagaaccaatcataaacttctacgacccacttgttttcccatcagatgaatttgatgcctccatatcacaagtaaacgaaaaaataaaccaatctctagccttcatcagaaaatccgacgaacttttacacaacgtaaacgtaggtaaatcaacaaccaacatcatgataacaacaataataatagtaataattgtaatacttttactacttatcgccgtaggcctattcttatattgtaaagcaagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13755 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut0 (opt11)
  source 1..1856: mol_type = other RNA
gggagacccgtgacccggaagttgtacggctacgcgactttccctcccacaaaccctcgcgcccttcctttcctacttgggcccggcagaaagcttaccatggaactaccaatcctcaaaaccaacgccatcactacaatcctagccgcggtaaccctgtgcttcgcctcctcacaaaacatcacagaagaattttaccaatcaacctgctccgccgtatccaaaggatacctgagcgccctgagaaccggctggtacacctccgtcatcaccatagaactctccaacatcaaagaaaacaaatgcaacggtacggacgccaaagttaaactcatcaaacaagaacttgacaaatacaagaacgccgtcacagaactgcaactcctcatgcaatccacccccgccgccggctccggctccgccatagcctccggcatcgccgtctgcaaagtcttacacctagaaggcgaagtcaacaaaatcaaaaacgcactactttccacaaacaaagccgtcgtctcactctccaacggcgtatccgtcctcaccttcaaagtacttgacctcaaaaactacatcgacaaacaactactccccatcctgaacaaacaatcctgctcaatctccaacatcgaaaccgtaatcgagttccaacagaaaaataatcgcctcctggagatcacccgcgagttctccgtcaatgcaggagtcacaaccccagtatcaacctacatgctcaccaactccgaactcctgtcgctcatcaacgacatgcccatcacaaacgaccaaaagaaactcatgtccaacaacgtacaaatcgtcagacaacaatcctattctataatgtgcatcatcaaagaagaagtcctcgcctacgtcgtacaactccccctctacggcgttatcgacaccccctgctggaaactccacacctcacccctctgcaccaccaacacaaaagaaggctccaacatctgcctcactcggaccgaccgcggctggtactgcgacaatgccggcagcgtctccttcttcccacaagccgaaacctgcaaagtccagtccaaccgcgtattctgcgacactatgaactccagaaccctcccctccgaagtaaacctctgcaacatcgacatcttcaacccaaaatacgactgcaaaatcatgacctcaaaaaccgacgtcagctcgtcagtcataaccagcctcggagccatagtctcatgctacggaaaaaccaaatgcaccgccagcaacaaaaaccgcggcataataaaaacattctccaacggctgcgactatgtatccaacaaaggagtcgataccgtctccgtaggcaacaccctatactacgtcaacaaacaagaaggcaaatccctctacgtcaaaggtgaaccaatcatcaacttctacgaccctctcgtcttcccctccgatgagttcgacgcctcaatcagccaagtaaacgaaaagataaaccaatcactcgccttcatccgcaaatccgacgaacttcttcacaacgtcaacgtcggcaaatctaccaccaacataatgataaccaccatcatcatcgtcatcatcgtaatactcctccttctcatcgccgtcggcctattcctatactgcaaagcccgctagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13756 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut0 (opt1)
  source 1..1826: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13757 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut0 (opt1)
  source 1..1826: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13758 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut0 (opt2)
  source 1..1826: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13759 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut0 (opt3)
  source 1..1826: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13760 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut0 (opt4)
  source 1..1826: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13761 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut0 (opt5)
  source 1..1826: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13762 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut0 (opt6)
  source 1..1826: mol_type = other RNA
gggagactttcccattctgtagcagaatttggtgttgcctgtggtcttggtcccgcggagaagcttaccatggaactcccaatacttaaaacaaacgcaatcacaacaatactagctgcagtcacactatgcttcgcctcatcacaaaatataacagaagaattttatcaatcaacatgctccgcagtatcaaaaggatatctctctgcattacgaacaggttggtacacctcggtaataacaatagaattatcaaacataaaagaaaataaatgcaatggaaccgatgccaaagtaaaactaatcaaacaagaacttgacaaatacaaaaacgcagtaacagaactacaactattaatgcaatcaacaccagcagcaggttcaggctccgcaatcgcttcaggaatagccgtttgtaaagtactacacttagaaggagaagtaaataaaataaaaaacgccttactatcaacaaacaaagcagtagtctccctttccaacggagtatcagtcttaacttttaaagtactcgacttaaaaaattacatcgacaaacaactactacccattctaaataaacaatcatgctcaatatcaaacatcgaaacagtaatcgaatttcaacaaaaaaataatagattactagaaataacacgagaattttccgtaaatgccggagtaacgaccccagtctcaacatacatgttaacaaactcagaattactatcactcattaacgatatgccaataacaaatgaccaaaaaaaactaatgtcaaacaacgtccaaatagtacgacaacaatcatactctatcatgtgtataataaaagaagaagttttagcatacgtagtacaactaccactttacggagtcatagacaccccatgctggaaactacacacatcacccttatgtacaacaaacaccaaagaagggtctaacatatgtctcactagaacagatcgaggctggtactgcgacaacgcaggatcagttagctttttccctcaagccgaaacctgtaaagtacaatccaatcgagtattttgcgacactatgaactctagaaccttaccctccgaagtaaacctatgtaacatagacatatttaatcccaaatatgattgcaaaatcatgacatccaaaacagatgtatcaagctctgtaataacctcactaggagcaatagtttcatgctatggtaaaacaaaatgcaccgcctcaaacaaaaatagagggataatcaaaaccttctcaaatggatgcgactacgtatcaaataaaggagtagacaccgtctccgtaggaaacacactatactacgtaaacaaacaagaaggaaaatcactatacgtaaaaggagaaccaatcataaacttctacgacccacttgttttcccatcagatgaatttgatgcctccatatcacaagtaaacgaaaaaataaaccaatctctagccttcatcagaaaatccgacgaacttttacacaacgtaaacgtaggtaaatcaacaaccaacatcatgataacaacaataataatagtaataattgtaatacttttactacttatcgccgtaggcctattcttatattgtaaagcaagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13763 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut0 (opt11)
  source 1..1826: mol_type = other RNA
gggagactttcccattctgtagcagaatttggtgttgcctgtggtcttggtcccgcggagaagcttaccatggaactaccaatcctcaaaaccaacgccatcactacaatcctagccgcggtaaccctgtgcttcgcctcctcacaaaacatcacagaagaattttaccaatcaacctgctccgccgtatccaaaggatacctgagcgccctgagaaccggctggtacacctccgtcatcaccatagaactctccaacatcaaagaaaacaaatgcaacggtacggacgccaaagttaaactcatcaaacaagaacttgacaaatacaagaacgccgtcacagaactgcaactcctcatgcaatccacccccgccgccggctccggctccgccatagcctccggcatcgccgtctgcaaagtcttacacctagaaggcgaagtcaacaaaatcaaaaacgcactactttccacaaacaaagccgtcgtctcactctccaacggcgtatccgtcctcaccttcaaagtacttgacctcaaaaactacatcgacaaacaactactccccatcctgaacaaacaatcctgctcaatctccaacatcgaaaccgtaatcgagttccaacagaaaaataatcgcctcctggagatcacccgcgagttctccgtcaatgcaggagtcacaaccccagtatcaacctacatgctcaccaactccgaactcctgtcgctcatcaacgacatgcccatcacaaacgaccaaaagaaactcatgtccaacaacgtacaaatcgtcagacaacaatcctattctataatgtgcatcatcaaagaagaagtcctcgcctacgtcgtacaactccccctctacggcgttatcgacaccccctgctggaaactccacacctcacccctctgcaccaccaacacaaaagaaggctccaacatctgcctcactcggaccgaccgcggctggtactgcgacaatgccggcagcgtctccttcttcccacaagccgaaacctgcaaagtccagtccaaccgcgtattctgcgacactatgaactccagaaccctcccctccgaagtaaacctctgcaacatcgacatcttcaacccaaaatacgactgcaaaatcatgacctcaaaaaccgacgtcagctcgtcagtcataaccagcctcggagccatagtctcatgctacggaaaaaccaaatgcaccgccagcaacaaaaaccgcggcataataaaaacattctccaacggctgcgactatgtatccaacaaaggagtcgataccgtctccgtaggcaacaccctatactacgtcaacaaacaagaaggcaaatccctctacgtcaaaggtgaaccaatcatcaacttctacgaccctctcgtcttcccctccgatgagttcgacgcctcaatcagccaagtaaacgaaaagataaaccaatcactcgccttcatccgcaaatccgacgaacttcttcacaacgtcaacgtcggcaaatctaccaccaacataatgataaccaccatcatcatcgtcatcatcgtaatactcctccttctcatcgccgtcggcctattcctatactgcaaagcccgctagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13764 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut0 (opt1)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13765 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut0 (opt1)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13766 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut0 (opt2)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13767 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut0 (opt3)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13768 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut0 (opt4)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13769 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut0 (opt5)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13770 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut0 (opt6)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcccaatacttaaaacaaacgcaatcacaacaatactagctgcagtcacactatgcttcgcctcatcacaaaatataacagaagaattttatcaatcaacatgctccgcagtatcaaaaggatatctctctgcattacgaacaggttggtacacctcggtaataacaatagaattatcaaacataaaagaaaataaatgcaatggaaccgatgccaaagtaaaactaatcaaacaagaacttgacaaatacaaaaacgcagtaacagaactacaactattaatgcaatcaacaccagcagcaggttcaggctccgcaatcgcttcaggaatagccgtttgtaaagtactacacttagaaggagaagtaaataaaataaaaaacgccttactatcaacaaacaaagcagtagtctccctttccaacggagtatcagtcttaacttttaaagtactcgacttaaaaaattacatcgacaaacaactactacccattctaaataaacaatcatgctcaatatcaaacatcgaaacagtaatcgaatttcaacaaaaaaataatagattactagaaataacacgagaattttccgtaaatgccggagtaacgaccccagtctcaacatacatgttaacaaactcagaattactatcactcattaacgatatgccaataacaaatgaccaaaaaaaactaatgtcaaacaacgtccaaatagtacgacaacaatcatactctatcatgtgtataataaaagaagaagttttagcatacgtagtacaactaccactttacggagtcatagacaccccatgctggaaactacacacatcacccttatgtacaacaaacaccaaagaagggtctaacatatgtctcactagaacagatcgaggctggtactgcgacaacgcaggatcagttagctttttccctcaagccgaaacctgtaaagtacaatccaatcgagtattttgcgacactatgaactctagaaccttaccctccgaagtaaacctatgtaacatagacatatttaatcccaaatatgattgcaaaatcatgacatccaaaacagatgtatcaagctctgtaataacctcactaggagcaatagtttcatgctatggtaaaacaaaatgcaccgcctcaaacaaaaatagagggataatcaaaaccttctcaaatggatgcgactacgtatcaaataaaggagtagacaccgtctccgtaggaaacacactatactacgtaaacaaacaagaaggaaaatcactatacgtaaaaggagaaccaatcataaacttctacgacccacttgttttcccatcagatgaatttgatgcctccatatcacaagtaaacgaaaaaataaaccaatctctagccttcatcagaaaatccgacgaacttttacacaacgtaaacgtaggtaaatcaacaaccaacatcatgataacaacaataataatagtaataattgtaatacttttactacttatcgccgtaggcctattcttatattgtaaagcaagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13771 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut0 (opt11)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactaccaatcctcaaaaccaacgccatcactacaatcctagccgcggtaaccctgtgcttcgcctcctcacaaaacatcacagaagaattttaccaatcaacctgctccgccgtatccaaaggatacctgagcgccctgagaaccggctggtacacctccgtcatcaccatagaactctccaacatcaaagaaaacaaatgcaacggtacggacgccaaagttaaactcatcaaacaagaacttgacaaatacaagaacgccgtcacagaactgcaactcctcatgcaatccacccccgccgccggctccggctccgccatagcctccggcatcgccgtctgcaaagtcttacacctagaaggcgaagtcaacaaaatcaaaaacgcactactttccacaaacaaagccgtcgtctcactctccaacggcgtatccgtcctcaccttcaaagtacttgacctcaaaaactacatcgacaaacaactactccccatcctgaacaaacaatcctgctcaatctccaacatcgaaaccgtaatcgagttccaacagaaaaataatcgcctcctggagatcacccgcgagttctccgtcaatgcaggagtcacaaccccagtatcaacctacatgctcaccaactccgaactcctgtcgctcatcaacgacatgcccatcacaaacgaccaaaagaaactcatgtccaacaacgtacaaatcgtcagacaacaatcctattctataatgtgcatcatcaaagaagaagtcctcgcctacgtcgtacaactccccctctacggcgttatcgacaccccctgctggaaactccacacctcacccctctgcaccaccaacacaaaagaaggctccaacatctgcctcactcggaccgaccgcggctggtactgcgacaatgccggcagcgtctccttcttcccacaagccgaaacctgcaaagtccagtccaaccgcgtattctgcgacactatgaactccagaaccctcccctccgaagtaaacctctgcaacatcgacatcttcaacccaaaatacgactgcaaaatcatgacctcaaaaaccgacgtcagctcgtcagtcataaccagcctcggagccatagtctcatgctacggaaaaaccaaatgcaccgccagcaacaaaaaccgcggcataataaaaacattctccaacggctgcgactatgtatccaacaaaggagtcgataccgtctccgtaggcaacaccctatactacgtcaacaaacaagaaggcaaatccctctacgtcaaaggtgaaccaatcatcaacttctacgaccctctcgtcttcccctccgatgagttcgacgcctcaatcagccaagtaaacgaaaagataaaccaatcactcgccttcatccgcaaatccgacgaacttcttcacaacgtcaacgtcggcaaatctaccaccaacataatgataaccaccatcatcatcgtcatcatcgtaatactcctccttctcatcgccgtcggcctattcctatactgcaaagcccgctagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13772 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut0 (opt1)
  source 1..1847: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13773 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut0 (opt1)
  source 1..1847: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13774 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut0 (opt2)
  source 1..1847: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13775 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut0 (opt3)
  source 1..1847: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13776 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut0 (opt4)
  source 1..1847: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13777 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut0 (opt5)
  source 1..1847: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13778 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut0 (opt6)
  source 1..1847: mol_type = other RNA
gggagagcggctcggccattttgtcccagtcagtccggaggctgcggctgcagaagtaccgcctgcggagtaactgcaaagaagcttaccatggaactcccaatacttaaaacaaacgcaatcacaacaatactagctgcagtcacactatgcttcgcctcatcacaaaatataacagaagaattttatcaatcaacatgctccgcagtatcaaaaggatatctctctgcattacgaacaggttggtacacctcggtaataacaatagaattatcaaacataaaagaaaataaatgcaatggaaccgatgccaaagtaaaactaatcaaacaagaacttgacaaatacaaaaacgcagtaacagaactacaactattaatgcaatcaacaccagcagcaggttcaggctccgcaatcgcttcaggaatagccgtttgtaaagtactacacttagaaggagaagtaaataaaataaaaaacgccttactatcaacaaacaaagcagtagtctccctttccaacggagtatcagtcttaacttttaaagtactcgacttaaaaaattacatcgacaaacaactactacccattctaaataaacaatcatgctcaatatcaaacatcgaaacagtaatcgaatttcaacaaaaaaataatagattactagaaataacacgagaattttccgtaaatgccggagtaacgaccccagtctcaacatacatgttaacaaactcagaattactatcactcattaacgatatgccaataacaaatgaccaaaaaaaactaatgtcaaacaacgtccaaatagtacgacaacaatcatactctatcatgtgtataataaaagaagaagttttagcatacgtagtacaactaccactttacggagtcatagacaccccatgctggaaactacacacatcacccttatgtacaacaaacaccaaagaagggtctaacatatgtctcactagaacagatcgaggctggtactgcgacaacgcaggatcagttagctttttccctcaagccgaaacctgtaaagtacaatccaatcgagtattttgcgacactatgaactctagaaccttaccctccgaagtaaacctatgtaacatagacatatttaatcccaaatatgattgcaaaatcatgacatccaaaacagatgtatcaagctctgtaataacctcactaggagcaatagtttcatgctatggtaaaacaaaatgcaccgcctcaaacaaaaatagagggataatcaaaaccttctcaaatggatgcgactacgtatcaaataaaggagtagacaccgtctccgtaggaaacacactatactacgtaaacaaacaagaaggaaaatcactatacgtaaaaggagaaccaatcataaacttctacgacccacttgttttcccatcagatgaatttgatgcctccatatcacaagtaaacgaaaaaataaaccaatctctagccttcatcagaaaatccgacgaacttttacacaacgtaaacgtaggtaaatcaacaaccaacatcatgataacaacaataataatagtaataattgtaatacttttactacttatcgccgtaggcctattcttatattgtaaagcaagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13779 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut0 (opt11)
  source 1..1847: mol_type = other RNA
gggagagcggctcggccattttgtcccagtcagtccggaggctgcggctgcagaagtaccgcctgcggagtaactgcaaagaagcttaccatggaactaccaatcctcaaaaccaacgccatcactacaatcctagccgcggtaaccctgtgcttcgcctcctcacaaaacatcacagaagaattttaccaatcaacctgctccgccgtatccaaaggatacctgagcgccctgagaaccggctggtacacctccgtcatcaccatagaactctccaacatcaaagaaaacaaatgcaacggtacggacgccaaagttaaactcatcaaacaagaacttgacaaatacaagaacgccgtcacagaactgcaactcctcatgcaatccacccccgccgccggctccggctccgccatagcctccggcatcgccgtctgcaaagtcttacacctagaaggcgaagtcaacaaaatcaaaaacgcactactttccacaaacaaagccgtcgtctcactctccaacggcgtatccgtcctcaccttcaaagtacttgacctcaaaaactacatcgacaaacaactactccccatcctgaacaaacaatcctgctcaatctccaacatcgaaaccgtaatcgagttccaacagaaaaataatcgcctcctggagatcacccgcgagttctccgtcaatgcaggagtcacaaccccagtatcaacctacatgctcaccaactccgaactcctgtcgctcatcaacgacatgcccatcacaaacgaccaaaagaaactcatgtccaacaacgtacaaatcgtcagacaacaatcctattctataatgtgcatcatcaaagaagaagtcctcgcctacgtcgtacaactccccctctacggcgttatcgacaccccctgctggaaactccacacctcacccctctgcaccaccaacacaaaagaaggctccaacatctgcctcactcggaccgaccgcggctggtactgcgacaatgccggcagcgtctccttcttcccacaagccgaaacctgcaaagtccagtccaaccgcgtattctgcgacactatgaactccagaaccctcccctccgaagtaaacctctgcaacatcgacatcttcaacccaaaatacgactgcaaaatcatgacctcaaaaaccgacgtcagctcgtcagtcataaccagcctcggagccatagtctcatgctacggaaaaaccaaatgcaccgccagcaacaaaaaccgcggcataataaaaacattctccaacggctgcgactatgtatccaacaaaggagtcgataccgtctccgtaggcaacaccctatactacgtcaacaaacaagaaggcaaatccctctacgtcaaaggtgaaccaatcatcaacttctacgaccctctcgtcttcccctccgatgagttcgacgcctcaatcagccaagtaaacgaaaagataaaccaatcactcgccttcatccgcaaatccgacgaacttcttcacaacgtcaacgtcggcaaatctaccaccaacataatgataaccaccatcatcatcgtcatcatcgtaatactcctccttctcatcgccgtcggcctattcctatactgcaaagcccgctagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13780 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut0 (opt1)
  source 1..1914: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13781 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut0 (opt1)
  source 1..1914: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13782 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut0 (opt2)
  source 1..1914: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13783 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut0 (opt3)
  source 1..1914: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13784 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut0 (opt4)
  source 1..1914: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13785 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut0 (opt5)
  source 1..1914: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13786 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut0 (opt6)
  source 1..1914: mol_type = other RNA
gggagagcggctcggccattttgtcccagtcagtccggaggctgcggctgcagaagtaccgcctgcggagtaactgcaaagaagcttaccatggaactcccaatacttaaaacaaacgcaatcacaacaatactagctgcagtcacactatgcttcgcctcatcacaaaatataacagaagaattttatcaatcaacatgctccgcagtatcaaaaggatatctctctgcattacgaacaggttggtacacctcggtaataacaatagaattatcaaacataaaagaaaataaatgcaatggaaccgatgccaaagtaaaactaatcaaacaagaacttgacaaatacaaaaacgcagtaacagaactacaactattaatgcaatcaacaccagcagcaggttcaggctccgcaatcgcttcaggaatagccgtttgtaaagtactacacttagaaggagaagtaaataaaataaaaaacgccttactatcaacaaacaaagcagtagtctccctttccaacggagtatcagtcttaacttttaaagtactcgacttaaaaaattacatcgacaaacaactactacccattctaaataaacaatcatgctcaatatcaaacatcgaaacagtaatcgaatttcaacaaaaaaataatagattactagaaataacacgagaattttccgtaaatgccggagtaacgaccccagtctcaacatacatgttaacaaactcagaattactatcactcattaacgatatgccaataacaaatgaccaaaaaaaactaatgtcaaacaacgtccaaatagtacgacaacaatcatactctatcatgtgtataataaaagaagaagttttagcatacgtagtacaactaccactttacggagtcatagacaccccatgctggaaactacacacatcacccttatgtacaacaaacaccaaagaagggtctaacatatgtctcactagaacagatcgaggctggtactgcgacaacgcaggatcagttagctttttccctcaagccgaaacctgtaaagtacaatccaatcgagtattttgcgacactatgaactctagaaccttaccctccgaagtaaacctatgtaacatagacatatttaatcccaaatatgattgcaaaatcatgacatccaaaacagatgtatcaagctctgtaataacctcactaggagcaatagtttcatgctatggtaaaacaaaatgcaccgcctcaaacaaaaatagagggataatcaaaaccttctcaaatggatgcgactacgtatcaaataaaggagtagacaccgtctccgtaggaaacacactatactacgtaaacaaacaagaaggaaaatcactatacgtaaaaggagaaccaatcataaacttctacgacccacttgttttcccatcagatgaatttgatgcctccatatcacaagtaaacgaaaaaataaaccaatctctagccttcatcagaaaatccgacgaacttttacacaacgtaaacgtaggtaaatcaacaaccaacatcatgataacaacaataataatagtaataattgtaatacttttactacttatcgccgtaggcctattcttatattgtaaagcaagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13787 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut0 (opt11)
  source 1..1914: mol_type = other RNA
gggagagcggctcggccattttgtcccagtcagtccggaggctgcggctgcagaagtaccgcctgcggagtaactgcaaagaagcttaccatggaactaccaatcctcaaaaccaacgccatcactacaatcctagccgcggtaaccctgtgcttcgcctcctcacaaaacatcacagaagaattttaccaatcaacctgctccgccgtatccaaaggatacctgagcgccctgagaaccggctggtacacctccgtcatcaccatagaactctccaacatcaaagaaaacaaatgcaacggtacggacgccaaagttaaactcatcaaacaagaacttgacaaatacaagaacgccgtcacagaactgcaactcctcatgcaatccacccccgccgccggctccggctccgccatagcctccggcatcgccgtctgcaaagtcttacacctagaaggcgaagtcaacaaaatcaaaaacgcactactttccacaaacaaagccgtcgtctcactctccaacggcgtatccgtcctcaccttcaaagtacttgacctcaaaaactacatcgacaaacaactactccccatcctgaacaaacaatcctgctcaatctccaacatcgaaaccgtaatcgagttccaacagaaaaataatcgcctcctggagatcacccgcgagttctccgtcaatgcaggagtcacaaccccagtatcaacctacatgctcaccaactccgaactcctgtcgctcatcaacgacatgcccatcacaaacgaccaaaagaaactcatgtccaacaacgtacaaatcgtcagacaacaatcctattctataatgtgcatcatcaaagaagaagtcctcgcctacgtcgtacaactccccctctacggcgttatcgacaccccctgctggaaactccacacctcacccctctgcaccaccaacacaaaagaaggctccaacatctgcctcactcggaccgaccgcggctggtactgcgacaatgccggcagcgtctccttcttcccacaagccgaaacctgcaaagtccagtccaaccgcgtattctgcgacactatgaactccagaaccctcccctccgaagtaaacctctgcaacatcgacatcttcaacccaaaatacgactgcaaaatcatgacctcaaaaaccgacgtcagctcgtcagtcataaccagcctcggagccatagtctcatgctacggaaaaaccaaatgcaccgccagcaacaaaaaccgcggcataataaaaacattctccaacggctgcgactatgtatccaacaaaggagtcgataccgtctccgtaggcaacaccctatactacgtcaacaaacaagaaggcaaatccctctacgtcaaaggtgaaccaatcatcaacttctacgaccctctcgtcttcccctccgatgagttcgacgcctcaatcagccaagtaaacgaaaagataaaccaatcactcgccttcatccgcaaatccgacgaacttcttcacaacgtcaacgtcggcaaatctaccaccaacataatgataaccaccatcatcatcgtcatcatcgtaatactcctccttctcatcgccgtcggcctattcctatactgcaaagcccgctagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13788 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut0 (opt1)
  source 1..2130: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13789 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut0 (opt1)
  source 1..2130: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13790 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut0 (opt2)
  source 1..2130: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13791 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut0 (opt3)
  source 1..2130: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13792 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut0 (opt4)
  source 1..2130: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13793 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut0 (opt5)
  source 1..2130: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13794 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut0 (opt6)
  source 1..2130: mol_type = other RNA
gggagagcggctcggccattttgtcccagtcagtccggaggctgcggctgcagaagtaccgcctgcggagtaactgcaaagaagcttaccatggaactcccaatacttaaaacaaacgcaatcacaacaatactagctgcagtcacactatgcttcgcctcatcacaaaatataacagaagaattttatcaatcaacatgctccgcagtatcaaaaggatatctctctgcattacgaacaggttggtacacctcggtaataacaatagaattatcaaacataaaagaaaataaatgcaatggaaccgatgccaaagtaaaactaatcaaacaagaacttgacaaatacaaaaacgcagtaacagaactacaactattaatgcaatcaacaccagcagcaggttcaggctccgcaatcgcttcaggaatagccgtttgtaaagtactacacttagaaggagaagtaaataaaataaaaaacgccttactatcaacaaacaaagcagtagtctccctttccaacggagtatcagtcttaacttttaaagtactcgacttaaaaaattacatcgacaaacaactactacccattctaaataaacaatcatgctcaatatcaaacatcgaaacagtaatcgaatttcaacaaaaaaataatagattactagaaataacacgagaattttccgtaaatgccggagtaacgaccccagtctcaacatacatgttaacaaactcagaattactatcactcattaacgatatgccaataacaaatgaccaaaaaaaactaatgtcaaacaacgtccaaatagtacgacaacaatcatactctatcatgtgtataataaaagaagaagttttagcatacgtagtacaactaccactttacggagtcatagacaccccatgctggaaactacacacatcacccttatgtacaacaaacaccaaagaagggtctaacatatgtctcactagaacagatcgaggctggtactgcgacaacgcaggatcagttagctttttccctcaagccgaaacctgtaaagtacaatccaatcgagtattttgcgacactatgaactctagaaccttaccctccgaagtaaacctatgtaacatagacatatttaatcccaaatatgattgcaaaatcatgacatccaaaacagatgtatcaagctctgtaataacctcactaggagcaatagtttcatgctatggtaaaacaaaatgcaccgcctcaaacaaaaatagagggataatcaaaaccttctcaaatggatgcgactacgtatcaaataaaggagtagacaccgtctccgtaggaaacacactatactacgtaaacaaacaagaaggaaaatcactatacgtaaaaggagaaccaatcataaacttctacgacccacttgttttcccatcagatgaatttgatgcctccatatcacaagtaaacgaaaaaataaaccaatctctagccttcatcagaaaatccgacgaacttttacacaacgtaaacgtaggtaaatcaacaaccaacatcatgataacaacaataataatagtaataattgtaatacttttactacttatcgccgtaggcctattcttatattgtaaagcaagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13795 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut0 (opt11)
  source 1..2130: mol_type = other RNA
gggagagcggctcggccattttgtcccagtcagtccggaggctgcggctgcagaagtaccgcctgcggagtaactgcaaagaagcttaccatggaactaccaatcctcaaaaccaacgccatcactacaatcctagccgcggtaaccctgtgcttcgcctcctcacaaaacatcacagaagaattttaccaatcaacctgctccgccgtatccaaaggatacctgagcgccctgagaaccggctggtacacctccgtcatcaccatagaactctccaacatcaaagaaaacaaatgcaacggtacggacgccaaagttaaactcatcaaacaagaacttgacaaatacaagaacgccgtcacagaactgcaactcctcatgcaatccacccccgccgccggctccggctccgccatagcctccggcatcgccgtctgcaaagtcttacacctagaaggcgaagtcaacaaaatcaaaaacgcactactttccacaaacaaagccgtcgtctcactctccaacggcgtatccgtcctcaccttcaaagtacttgacctcaaaaactacatcgacaaacaactactccccatcctgaacaaacaatcctgctcaatctccaacatcgaaaccgtaatcgagttccaacagaaaaataatcgcctcctggagatcacccgcgagttctccgtcaatgcaggagtcacaaccccagtatcaacctacatgctcaccaactccgaactcctgtcgctcatcaacgacatgcccatcacaaacgaccaaaagaaactcatgtccaacaacgtacaaatcgtcagacaacaatcctattctataatgtgcatcatcaaagaagaagtcctcgcctacgtcgtacaactccccctctacggcgttatcgacaccccctgctggaaactccacacctcacccctctgcaccaccaacacaaaagaaggctccaacatctgcctcactcggaccgaccgcggctggtactgcgacaatgccggcagcgtctccttcttcccacaagccgaaacctgcaaagtccagtccaaccgcgtattctgcgacactatgaactccagaaccctcccctccgaagtaaacctctgcaacatcgacatcttcaacccaaaatacgactgcaaaatcatgacctcaaaaaccgacgtcagctcgtcagtcataaccagcctcggagccatagtctcatgctacggaaaaaccaaatgcaccgccagcaacaaaaaccgcggcataataaaaacattctccaacggctgcgactatgtatccaacaaaggagtcgataccgtctccgtaggcaacaccctatactacgtcaacaaacaagaaggcaaatccctctacgtcaaaggtgaaccaatcatcaacttctacgaccctctcgtcttcccctccgatgagttcgacgcctcaatcagccaagtaaacgaaaagataaaccaatcactcgccttcatccgcaaatccgacgaacttcttcacaacgtcaacgtcggcaaatctaccaccaacataatgataaccaccatcatcatcgtcatcatcgtaatactcctccttctcatcgccgtcggcctattcctatactgcaaagcccgctagggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13796 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut0 (opt1)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13797 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut0 (opt1)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13798 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut0 (opt2)
  source 1..1910: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13799 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut0 (opt3)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13800 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut0 (opt4)
  source 1..1910: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13801 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut0 (opt5)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13802 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut0 (opt6)
  source 1..1910: mol_type = other RNA
gggagagcggctcggccattttgtcccagtcagtccggaggctgcggctgcagaagtaccgcctgcggagtaactgcaaagaagcttaccatggaactcccaatacttaaaacaaacgcaatcacaacaatactagctgcagtcacactatgcttcgcctcatcacaaaatataacagaagaattttatcaatcaacatgctccgcagtatcaaaaggatatctctctgcattacgaacaggttggtacacctcggtaataacaatagaattatcaaacataaaagaaaataaatgcaatggaaccgatgccaaagtaaaactaatcaaacaagaacttgacaaatacaaaaacgcagtaacagaactacaactattaatgcaatcaacaccagcagcaggttcaggctccgcaatcgcttcaggaatagccgtttgtaaagtactacacttagaaggagaagtaaataaaataaaaaacgccttactatcaacaaacaaagcagtagtctccctttccaacggagtatcagtcttaacttttaaagtactcgacttaaaaaattacatcgacaaacaactactacccattctaaataaacaatcatgctcaatatcaaacatcgaaacagtaatcgaatttcaacaaaaaaataatagattactagaaataacacgagaattttccgtaaatgccggagtaacgaccccagtctcaacatacatgttaacaaactcagaattactatcactcattaacgatatgccaataacaaatgaccaaaaaaaactaatgtcaaacaacgtccaaatagtacgacaacaatcatactctatcatgtgtataataaaagaagaagttttagcatacgtagtacaactaccactttacggagtcatagacaccccatgctggaaactacacacatcacccttatgtacaacaaacaccaaagaagggtctaacatatgtctcactagaacagatcgaggctggtactgcgacaacgcaggatcagttagctttttccctcaagccgaaacctgtaaagtacaatccaatcgagtattttgcgacactatgaactctagaaccttaccctccgaagtaaacctatgtaacatagacatatttaatcccaaatatgattgcaaaatcatgacatccaaaacagatgtatcaagctctgtaataacctcactaggagcaatagtttcatgctatggtaaaacaaaatgcaccgcctcaaacaaaaatagagggataatcaaaaccttctcaaatggatgcgactacgtatcaaataaaggagtagacaccgtctccgtaggaaacacactatactacgtaaacaaacaagaaggaaaatcactatacgtaaaaggagaaccaatcataaacttctacgacccacttgttttcccatcagatgaatttgatgcctccatatcacaagtaaacgaaaaaataaaccaatctctagccttcatcagaaaatccgacgaacttttacacaacgtaaacgtaggtaaatcaacaaccaacatcatgataacaacaataataatagtaataattgtaatacttttactacttatcgccgtaggcctattcttatattgtaaagcaagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13803 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut0 (opt11)
  source 1..1910: mol_type = other RNA
gggagagcggctcggccattttgtcccagtcagtccggaggctgcggctgcagaagtaccgcctgcggagtaactgcaaagaagcttaccatggaactaccaatcctcaaaaccaacgccatcactacaatcctagccgcggtaaccctgtgcttcgcctcctcacaaaacatcacagaagaattttaccaatcaacctgctccgccgtatccaaaggatacctgagcgccctgagaaccggctggtacacctccgtcatcaccatagaactctccaacatcaaagaaaacaaatgcaacggtacggacgccaaagttaaactcatcaaacaagaacttgacaaatacaagaacgccgtcacagaactgcaactcctcatgcaatccacccccgccgccggctccggctccgccatagcctccggcatcgccgtctgcaaagtcttacacctagaaggcgaagtcaacaaaatcaaaaacgcactactttccacaaacaaagccgtcgtctcactctccaacggcgtatccgtcctcaccttcaaagtacttgacctcaaaaactacatcgacaaacaactactccccatcctgaacaaacaatcctgctcaatctccaacatcgaaaccgtaatcgagttccaacagaaaaataatcgcctcctggagatcacccgcgagttctccgtcaatgcaggagtcacaaccccagtatcaacctacatgctcaccaactccgaactcctgtcgctcatcaacgacatgcccatcacaaacgaccaaaagaaactcatgtccaacaacgtacaaatcgtcagacaacaatcctattctataatgtgcatcatcaaagaagaagtcctcgcctacgtcgtacaactccccctctacggcgttatcgacaccccctgctggaaactccacacctcacccctctgcaccaccaacacaaaagaaggctccaacatctgcctcactcggaccgaccgcggctggtactgcgacaatgccggcagcgtctccttcttcccacaagccgaaacctgcaaagtccagtccaaccgcgtattctgcgacactatgaactccagaaccctcccctccgaagtaaacctctgcaacatcgacatcttcaacccaaaatacgactgcaaaatcatgacctcaaaaaccgacgtcagctcgtcagtcataaccagcctcggagccatagtctcatgctacggaaaaaccaaatgcaccgccagcaacaaaaaccgcggcataataaaaacattctccaacggctgcgactatgtatccaacaaaggagtcgataccgtctccgtaggcaacaccctatactacgtcaacaaacaagaaggcaaatccctctacgtcaaaggtgaaccaatcatcaacttctacgaccctctcgtcttcccctccgatgagttcgacgcctcaatcagccaagtaaacgaaaagataaaccaatcactcgccttcatccgcaaatccgacgaacttcttcacaacgtcaacgtcggcaaatctaccaccaacataatgataaccaccatcatcatcgtcatcatcgtaatactcctccttctcatcgccgtcggcctattcctatactgcaaagcccgctagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13804 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut0 (opt1)
  source 1..1901: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13805 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut0 (opt1)
  source 1..1901: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13806 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut0 (opt2)
  source 1..1901: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13807 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut0 (opt3)
  source 1..1901: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13808 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut0 (opt4)
  source 1..1901: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13809 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut0 (opt5)
  source 1..1901: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13810 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut0 (opt6)
  source 1..1901: mol_type = other RNA
gggagagtcccgcagtcggcgtccagcggctctgcttgttcgtgtgtgtgtcgttgcaggccttattcaagcttaccatggaactcccaatacttaaaacaaacgcaatcacaacaatactagctgcagtcacactatgcttcgcctcatcacaaaatataacagaagaattttatcaatcaacatgctccgcagtatcaaaaggatatctctctgcattacgaacaggttggtacacctcggtaataacaatagaattatcaaacataaaagaaaataaatgcaatggaaccgatgccaaagtaaaactaatcaaacaagaacttgacaaatacaaaaacgcagtaacagaactacaactattaatgcaatcaacaccagcagcaggttcaggctccgcaatcgcttcaggaatagccgtttgtaaagtactacacttagaaggagaagtaaataaaataaaaaacgccttactatcaacaaacaaagcagtagtctccctttccaacggagtatcagtcttaacttttaaagtactcgacttaaaaaattacatcgacaaacaactactacccattctaaataaacaatcatgctcaatatcaaacatcgaaacagtaatcgaatttcaacaaaaaaataatagattactagaaataacacgagaattttccgtaaatgccggagtaacgaccccagtctcaacatacatgttaacaaactcagaattactatcactcattaacgatatgccaataacaaatgaccaaaaaaaactaatgtcaaacaacgtccaaatagtacgacaacaatcatactctatcatgtgtataataaaagaagaagttttagcatacgtagtacaactaccactttacggagtcatagacaccccatgctggaaactacacacatcacccttatgtacaacaaacaccaaagaagggtctaacatatgtctcactagaacagatcgaggctggtactgcgacaacgcaggatcagttagctttttccctcaagccgaaacctgtaaagtacaatccaatcgagtattttgcgacactatgaactctagaaccttaccctccgaagtaaacctatgtaacatagacatatttaatcccaaatatgattgcaaaatcatgacatccaaaacagatgtatcaagctctgtaataacctcactaggagcaatagtttcatgctatggtaaaacaaaatgcaccgcctcaaacaaaaatagagggataatcaaaaccttctcaaatggatgcgactacgtatcaaataaaggagtagacaccgtctccgtaggaaacacactatactacgtaaacaaacaagaaggaaaatcactatacgtaaaaggagaaccaatcataaacttctacgacccacttgttttcccatcagatgaatttgatgcctccatatcacaagtaaacgaaaaaataaaccaatctctagccttcatcagaaaatccgacgaacttttacacaacgtaaacgtaggtaaatcaacaaccaacatcatgataacaacaataataatagtaataattgtaatacttttactacttatcgccgtaggcctattcttatattgtaaagcaagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13811 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut0 (opt11)
  source 1..1901: mol_type = other RNA
gggagagtcccgcagtcggcgtccagcggctctgcttgttcgtgtgtgtgtcgttgcaggccttattcaagcttaccatggaactaccaatcctcaaaaccaacgccatcactacaatcctagccgcggtaaccctgtgcttcgcctcctcacaaaacatcacagaagaattttaccaatcaacctgctccgccgtatccaaaggatacctgagcgccctgagaaccggctggtacacctccgtcatcaccatagaactctccaacatcaaagaaaacaaatgcaacggtacggacgccaaagttaaactcatcaaacaagaacttgacaaatacaagaacgccgtcacagaactgcaactcctcatgcaatccacccccgccgccggctccggctccgccatagcctccggcatcgccgtctgcaaagtcttacacctagaaggcgaagtcaacaaaatcaaaaacgcactactttccacaaacaaagccgtcgtctcactctccaacggcgtatccgtcctcaccttcaaagtacttgacctcaaaaactacatcgacaaacaactactccccatcctgaacaaacaatcctgctcaatctccaacatcgaaaccgtaatcgagttccaacagaaaaataatcgcctcctggagatcacccgcgagttctccgtcaatgcaggagtcacaaccccagtatcaacctacatgctcaccaactccgaactcctgtcgctcatcaacgacatgcccatcacaaacgaccaaaagaaactcatgtccaacaacgtacaaatcgtcagacaacaatcctattctataatgtgcatcatcaaagaagaagtcctcgcctacgtcgtacaactccccctctacggcgttatcgacaccccctgctggaaactccacacctcacccctctgcaccaccaacacaaaagaaggctccaacatctgcctcactcggaccgaccgcggctggtactgcgacaatgccggcagcgtctccttcttcccacaagccgaaacctgcaaagtccagtccaaccgcgtattctgcgacactatgaactccagaaccctcccctccgaagtaaacctctgcaacatcgacatcttcaacccaaaatacgactgcaaaatcatgacctcaaaaaccgacgtcagctcgtcagtcataaccagcctcggagccatagtctcatgctacggaaaaaccaaatgcaccgccagcaacaaaaaccgcggcataataaaaacattctccaacggctgcgactatgtatccaacaaaggagtcgataccgtctccgtaggcaacaccctatactacgtcaacaaacaagaaggcaaatccctctacgtcaaaggtgaaccaatcatcaacttctacgaccctctcgtcttcccctccgatgagttcgacgcctcaatcagccaagtaaacgaaaagataaaccaatcactcgccttcatccgcaaatccgacgaacttcttcacaacgtcaacgtcggcaaatctaccaccaacataatgataaccaccatcatcatcgtcatcatcgtaatactcctccttctcatcgccgtcggcctattcctatactgcaaagcccgctagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13812 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut0 (opt1)
  source 1..2117: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13813 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut0 (opt1)
  source 1..2117: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13814 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut0 (opt2)
  source 1..2117: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13815 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut0 (opt3)
  source 1..2117: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13816 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut0 (opt4)
  source 1..2117: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13817 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut0 (opt5)
  source 1..2117: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13818 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut0 (opt6)
  source 1..2117: mol_type = other RNA
gggagagtcccgcagtcggcgtccagcggctctgcttgttcgtgtgtgtgtcgttgcaggccttattcaagcttaccatggaactcccaatacttaaaacaaacgcaatcacaacaatactagctgcagtcacactatgcttcgcctcatcacaaaatataacagaagaattttatcaatcaacatgctccgcagtatcaaaaggatatctctctgcattacgaacaggttggtacacctcggtaataacaatagaattatcaaacataaaagaaaataaatgcaatggaaccgatgccaaagtaaaactaatcaaacaagaacttgacaaatacaaaaacgcagtaacagaactacaactattaatgcaatcaacaccagcagcaggttcaggctccgcaatcgcttcaggaatagccgtttgtaaagtactacacttagaaggagaagtaaataaaataaaaaacgccttactatcaacaaacaaagcagtagtctccctttccaacggagtatcagtcttaacttttaaagtactcgacttaaaaaattacatcgacaaacaactactacccattctaaataaacaatcatgctcaatatcaaacatcgaaacagtaatcgaatttcaacaaaaaaataatagattactagaaataacacgagaattttccgtaaatgccggagtaacgaccccagtctcaacatacatgttaacaaactcagaattactatcactcattaacgatatgccaataacaaatgaccaaaaaaaactaatgtcaaacaacgtccaaatagtacgacaacaatcatactctatcatgtgtataataaaagaagaagttttagcatacgtagtacaactaccactttacggagtcatagacaccccatgctggaaactacacacatcacccttatgtacaacaaacaccaaagaagggtctaacatatgtctcactagaacagatcgaggctggtactgcgacaacgcaggatcagttagctttttccctcaagccgaaacctgtaaagtacaatccaatcgagtattttgcgacactatgaactctagaaccttaccctccgaagtaaacctatgtaacatagacatatttaatcccaaatatgattgcaaaatcatgacatccaaaacagatgtatcaagctctgtaataacctcactaggagcaatagtttcatgctatggtaaaacaaaatgcaccgcctcaaacaaaaatagagggataatcaaaaccttctcaaatggatgcgactacgtatcaaataaaggagtagacaccgtctccgtaggaaacacactatactacgtaaacaaacaagaaggaaaatcactatacgtaaaaggagaaccaatcataaacttctacgacccacttgttttcccatcagatgaatttgatgcctccatatcacaagtaaacgaaaaaataaaccaatctctagccttcatcagaaaatccgacgaacttttacacaacgtaaacgtaggtaaatcaacaaccaacatcatgataacaacaataataatagtaataattgtaatacttttactacttatcgccgtaggcctattcttatattgtaaagcaagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13819 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut0 (opt11)
  source 1..2117: mol_type = other RNA
gggagagtcccgcagtcggcgtccagcggctctgcttgttcgtgtgtgtgtcgttgcaggccttattcaagcttaccatggaactaccaatcctcaaaaccaacgccatcactacaatcctagccgcggtaaccctgtgcttcgcctcctcacaaaacatcacagaagaattttaccaatcaacctgctccgccgtatccaaaggatacctgagcgccctgagaaccggctggtacacctccgtcatcaccatagaactctccaacatcaaagaaaacaaatgcaacggtacggacgccaaagttaaactcatcaaacaagaacttgacaaatacaagaacgccgtcacagaactgcaactcctcatgcaatccacccccgccgccggctccggctccgccatagcctccggcatcgccgtctgcaaagtcttacacctagaaggcgaagtcaacaaaatcaaaaacgcactactttccacaaacaaagccgtcgtctcactctccaacggcgtatccgtcctcaccttcaaagtacttgacctcaaaaactacatcgacaaacaactactccccatcctgaacaaacaatcctgctcaatctccaacatcgaaaccgtaatcgagttccaacagaaaaataatcgcctcctggagatcacccgcgagttctccgtcaatgcaggagtcacaaccccagtatcaacctacatgctcaccaactccgaactcctgtcgctcatcaacgacatgcccatcacaaacgaccaaaagaaactcatgtccaacaacgtacaaatcgtcagacaacaatcctattctataatgtgcatcatcaaagaagaagtcctcgcctacgtcgtacaactccccctctacggcgttatcgacaccccctgctggaaactccacacctcacccctctgcaccaccaacacaaaagaaggctccaacatctgcctcactcggaccgaccgcggctggtactgcgacaatgccggcagcgtctccttcttcccacaagccgaaacctgcaaagtccagtccaaccgcgtattctgcgacactatgaactccagaaccctcccctccgaagtaaacctctgcaacatcgacatcttcaacccaaaatacgactgcaaaatcatgacctcaaaaaccgacgtcagctcgtcagtcataaccagcctcggagccatagtctcatgctacggaaaaaccaaatgcaccgccagcaacaaaaaccgcggcataataaaaacattctccaacggctgcgactatgtatccaacaaaggagtcgataccgtctccgtaggcaacaccctatactacgtcaacaaacaagaaggcaaatccctctacgtcaaaggtgaaccaatcatcaacttctacgaccctctcgtcttcccctccgatgagttcgacgcctcaatcagccaagtaaacgaaaagataaaccaatcactcgccttcatccgcaaatccgacgaacttcttcacaacgtcaacgtcggcaaatctaccaccaacataatgataaccaccatcatcatcgtcatcatcgtaatactcctccttctcatcgccgtcggcctattcctatactgcaaagcccgctagggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13820 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut0 (opt1)
  source 1..1893: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13821 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut0 (opt1)
  source 1..1893: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13822 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut0 (opt2)
  source 1..1893: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13823 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut0 (opt3)
  source 1..1893: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13824 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut0 (opt4)
  source 1..1893: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13825 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut0 (opt5)
  source 1..1893: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13826 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut0 (opt6)
  source 1..1893: mol_type = other RNA
gggagactttcccattctgtagcagaatttggtgttgcctgtggtcttggtcccgcggagaagcttaccatggaactcccaatacttaaaacaaacgcaatcacaacaatactagctgcagtcacactatgcttcgcctcatcacaaaatataacagaagaattttatcaatcaacatgctccgcagtatcaaaaggatatctctctgcattacgaacaggttggtacacctcggtaataacaatagaattatcaaacataaaagaaaataaatgcaatggaaccgatgccaaagtaaaactaatcaaacaagaacttgacaaatacaaaaacgcagtaacagaactacaactattaatgcaatcaacaccagcagcaggttcaggctccgcaatcgcttcaggaatagccgtttgtaaagtactacacttagaaggagaagtaaataaaataaaaaacgccttactatcaacaaacaaagcagtagtctccctttccaacggagtatcagtcttaacttttaaagtactcgacttaaaaaattacatcgacaaacaactactacccattctaaataaacaatcatgctcaatatcaaacatcgaaacagtaatcgaatttcaacaaaaaaataatagattactagaaataacacgagaattttccgtaaatgccggagtaacgaccccagtctcaacatacatgttaacaaactcagaattactatcactcattaacgatatgccaataacaaatgaccaaaaaaaactaatgtcaaacaacgtccaaatagtacgacaacaatcatactctatcatgtgtataataaaagaagaagttttagcatacgtagtacaactaccactttacggagtcatagacaccccatgctggaaactacacacatcacccttatgtacaacaaacaccaaagaagggtctaacatatgtctcactagaacagatcgaggctggtactgcgacaacgcaggatcagttagctttttccctcaagccgaaacctgtaaagtacaatccaatcgagtattttgcgacactatgaactctagaaccttaccctccgaagtaaacctatgtaacatagacatatttaatcccaaatatgattgcaaaatcatgacatccaaaacagatgtatcaagctctgtaataacctcactaggagcaatagtttcatgctatggtaaaacaaaatgcaccgcctcaaacaaaaatagagggataatcaaaaccttctcaaatggatgcgactacgtatcaaataaaggagtagacaccgtctccgtaggaaacacactatactacgtaaacaaacaagaaggaaaatcactatacgtaaaaggagaaccaatcataaacttctacgacccacttgttttcccatcagatgaatttgatgcctccatatcacaagtaaacgaaaaaataaaccaatctctagccttcatcagaaaatccgacgaacttttacacaacgtaaacgtaggtaaatcaacaaccaacatcatgataacaacaataataatagtaataattgtaatacttttactacttatcgccgtaggcctattcttatattgtaaagcaagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13827 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut0 (opt11)
  source 1..1893: mol_type = other RNA
gggagactttcccattctgtagcagaatttggtgttgcctgtggtcttggtcccgcggagaagcttaccatggaactaccaatcctcaaaaccaacgccatcactacaatcctagccgcggtaaccctgtgcttcgcctcctcacaaaacatcacagaagaattttaccaatcaacctgctccgccgtatccaaaggatacctgagcgccctgagaaccggctggtacacctccgtcatcaccatagaactctccaacatcaaagaaaacaaatgcaacggtacggacgccaaagttaaactcatcaaacaagaacttgacaaatacaagaacgccgtcacagaactgcaactcctcatgcaatccacccccgccgccggctccggctccgccatagcctccggcatcgccgtctgcaaagtcttacacctagaaggcgaagtcaacaaaatcaaaaacgcactactttccacaaacaaagccgtcgtctcactctccaacggcgtatccgtcctcaccttcaaagtacttgacctcaaaaactacatcgacaaacaactactccccatcctgaacaaacaatcctgctcaatctccaacatcgaaaccgtaatcgagttccaacagaaaaataatcgcctcctggagatcacccgcgagttctccgtcaatgcaggagtcacaaccccagtatcaacctacatgctcaccaactccgaactcctgtcgctcatcaacgacatgcccatcacaaacgaccaaaagaaactcatgtccaacaacgtacaaatcgtcagacaacaatcctattctataatgtgcatcatcaaagaagaagtcctcgcctacgtcgtacaactccccctctacggcgttatcgacaccccctgctggaaactccacacctcacccctctgcaccaccaacacaaaagaaggctccaacatctgcctcactcggaccgaccgcggctggtactgcgacaatgccggcagcgtctccttcttcccacaagccgaaacctgcaaagtccagtccaaccgcgtattctgcgacactatgaactccagaaccctcccctccgaagtaaacctctgcaacatcgacatcttcaacccaaaatacgactgcaaaatcatgacctcaaaaaccgacgtcagctcgtcagtcataaccagcctcggagccatagtctcatgctacggaaaaaccaaatgcaccgccagcaacaaaaaccgcggcataataaaaacattctccaacggctgcgactatgtatccaacaaaggagtcgataccgtctccgtaggcaacaccctatactacgtcaacaaacaagaaggcaaatccctctacgtcaaaggtgaaccaatcatcaacttctacgaccctctcgtcttcccctccgatgagttcgacgcctcaatcagccaagtaaacgaaaagataaaccaatcactcgccttcatccgcaaatccgacgaacttcttcacaacgtcaacgtcggcaaatctaccaccaacataatgataaccaccatcatcatcgtcatcatcgtaatactcctccttctcatcgccgtcggcctattcctatactgcaaagcccgctagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13828 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut0 (opt1)
  source 1..1889: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13829 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut0 (opt1)
  source 1..1889: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13830 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut0 (opt2)
  source 1..1889: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13831 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut0 (opt3)
  source 1..1889: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13832 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut0 (opt4)
  source 1..1889: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13833 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut0 (opt5)
  source 1..1889: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13834 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut0 (opt6)
  source 1..1889: mol_type = other RNA
gggagactttcccattctgtagcagaatttggtgttgcctgtggtcttggtcccgcggagaagcttaccatggaactcccaatacttaaaacaaacgcaatcacaacaatactagctgcagtcacactatgcttcgcctcatcacaaaatataacagaagaattttatcaatcaacatgctccgcagtatcaaaaggatatctctctgcattacgaacaggttggtacacctcggtaataacaatagaattatcaaacataaaagaaaataaatgcaatggaaccgatgccaaagtaaaactaatcaaacaagaacttgacaaatacaaaaacgcagtaacagaactacaactattaatgcaatcaacaccagcagcaggttcaggctccgcaatcgcttcaggaatagccgtttgtaaagtactacacttagaaggagaagtaaataaaataaaaaacgccttactatcaacaaacaaagcagtagtctccctttccaacggagtatcagtcttaacttttaaagtactcgacttaaaaaattacatcgacaaacaactactacccattctaaataaacaatcatgctcaatatcaaacatcgaaacagtaatcgaatttcaacaaaaaaataatagattactagaaataacacgagaattttccgtaaatgccggagtaacgaccccagtctcaacatacatgttaacaaactcagaattactatcactcattaacgatatgccaataacaaatgaccaaaaaaaactaatgtcaaacaacgtccaaatagtacgacaacaatcatactctatcatgtgtataataaaagaagaagttttagcatacgtagtacaactaccactttacggagtcatagacaccccatgctggaaactacacacatcacccttatgtacaacaaacaccaaagaagggtctaacatatgtctcactagaacagatcgaggctggtactgcgacaacgcaggatcagttagctttttccctcaagccgaaacctgtaaagtacaatccaatcgagtattttgcgacactatgaactctagaaccttaccctccgaagtaaacctatgtaacatagacatatttaatcccaaatatgattgcaaaatcatgacatccaaaacagatgtatcaagctctgtaataacctcactaggagcaatagtttcatgctatggtaaaacaaaatgcaccgcctcaaacaaaaatagagggataatcaaaaccttctcaaatggatgcgactacgtatcaaataaaggagtagacaccgtctccgtaggaaacacactatactacgtaaacaaacaagaaggaaaatcactatacgtaaaaggagaaccaatcataaacttctacgacccacttgttttcccatcagatgaatttgatgcctccatatcacaagtaaacgaaaaaataaaccaatctctagccttcatcagaaaatccgacgaacttttacacaacgtaaacgtaggtaaatcaacaaccaacatcatgataacaacaataataatagtaataattgtaatacttttactacttatcgccgtaggcctattcttatattgtaaagcaagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13835 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut0 (opt11)
  source 1..1889: mol_type = other RNA
gggagactttcccattctgtagcagaatttggtgttgcctgtggtcttggtcccgcggagaagcttaccatggaactaccaatcctcaaaaccaacgccatcactacaatcctagccgcggtaaccctgtgcttcgcctcctcacaaaacatcacagaagaattttaccaatcaacctgctccgccgtatccaaaggatacctgagcgccctgagaaccggctggtacacctccgtcatcaccatagaactctccaacatcaaagaaaacaaatgcaacggtacggacgccaaagttaaactcatcaaacaagaacttgacaaatacaagaacgccgtcacagaactgcaactcctcatgcaatccacccccgccgccggctccggctccgccatagcctccggcatcgccgtctgcaaagtcttacacctagaaggcgaagtcaacaaaatcaaaaacgcactactttccacaaacaaagccgtcgtctcactctccaacggcgtatccgtcctcaccttcaaagtacttgacctcaaaaactacatcgacaaacaactactccccatcctgaacaaacaatcctgctcaatctccaacatcgaaaccgtaatcgagttccaacagaaaaataatcgcctcctggagatcacccgcgagttctccgtcaatgcaggagtcacaaccccagtatcaacctacatgctcaccaactccgaactcctgtcgctcatcaacgacatgcccatcacaaacgaccaaaagaaactcatgtccaacaacgtacaaatcgtcagacaacaatcctattctataatgtgcatcatcaaagaagaagtcctcgcctacgtcgtacaactccccctctacggcgttatcgacaccccctgctggaaactccacacctcacccctctgcaccaccaacacaaaagaaggctccaacatctgcctcactcggaccgaccgcggctggtactgcgacaatgccggcagcgtctccttcttcccacaagccgaaacctgcaaagtccagtccaaccgcgtattctgcgacactatgaactccagaaccctcccctccgaagtaaacctctgcaacatcgacatcttcaacccaaaatacgactgcaaaatcatgacctcaaaaaccgacgtcagctcgtcagtcataaccagcctcggagccatagtctcatgctacggaaaaaccaaatgcaccgccagcaacaaaaaccgcggcataataaaaacattctccaacggctgcgactatgtatccaacaaaggagtcgataccgtctccgtaggcaacaccctatactacgtcaacaaacaagaaggcaaatccctctacgtcaaaggtgaaccaatcatcaacttctacgaccctctcgtcttcccctccgatgagttcgacgcctcaatcagccaagtaaacgaaaagataaaccaatcactcgccttcatccgcaaatccgacgaacttcttcacaacgtcaacgtcggcaaatctaccaccaacataatgataaccaccatcatcatcgtcatcatcgtaatactcctccttctcatcgccgtcggcctattcctatactgcaaagcccgctagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13836 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut0 (opt1)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13837 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut0 (opt1)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13838 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut0 (opt2)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13839 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut0 (opt3)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13840 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut0 (opt4)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13841 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut0 (opt5)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13842 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut0 (opt6)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggaactcccaatacttaaaacaaacgcaatcacaacaatactagctgcagtcacactatgcttcgcctcatcacaaaatataacagaagaattttatcaatcaacatgctccgcagtatcaaaaggatatctctctgcattacgaacaggttggtacacctcggtaataacaatagaattatcaaacataaaagaaaataaatgcaatggaaccgatgccaaagtaaaactaatcaaacaagaacttgacaaatacaaaaacgcagtaacagaactacaactattaatgcaatcaacaccagcagcaggttcaggctccgcaatcgcttcaggaatagccgtttgtaaagtactacacttagaaggagaagtaaataaaataaaaaacgccttactatcaacaaacaaagcagtagtctccctttccaacggagtatcagtcttaacttttaaagtactcgacttaaaaaattacatcgacaaacaactactacccattctaaataaacaatcatgctcaatatcaaacatcgaaacagtaatcgaatttcaacaaaaaaataatagattactagaaataacacgagaattttccgtaaatgccggagtaacgaccccagtctcaacatacatgttaacaaactcagaattactatcactcattaacgatatgccaataacaaatgaccaaaaaaaactaatgtcaaacaacgtccaaatagtacgacaacaatcatactctatcatgtgtataataaaagaagaagttttagcatacgtagtacaactaccactttacggagtcatagacaccccatgctggaaactacacacatcacccttatgtacaacaaacaccaaagaagggtctaacatatgtctcactagaacagatcgaggctggtactgcgacaacgcaggatcagttagctttttccctcaagccgaaacctgtaaagtacaatccaatcgagtattttgcgacactatgaactctagaaccttaccctccgaagtaaacctatgtaacatagacatatttaatcccaaatatgattgcaaaatcatgacatccaaaacagatgtatcaagctctgtaataacctcactaggagcaatagtttcatgctatggtaaaacaaaatgcaccgcctcaaacaaaaatagagggataatcaaaaccttctcaaatggatgcgactacgtatcaaataaaggagtagacaccgtctccgtaggaaacacactatactacgtaaacaaacaagaaggaaaatcactatacgtaaaaggagaaccaatcataaacttctacgacccacttgttttcccatcagatgaatttgatgcctccatatcacaagtaaacgaaaaaataaaccaatctctagccttcatcagaaaatccgacgaacttttacacaacgtaaacgtaggtaaatcaacaaccaacatcatgataacaacaataataatagtaataattgtaatacttttactacttatcgccgtaggcctattcttatattgtaaagcaagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13843 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut0 (opt11)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggaactaccaatcctcaaaaccaacgccatcactacaatcctagccgcggtaaccctgtgcttcgcctcctcacaaaacatcacagaagaattttaccaatcaacctgctccgccgtatccaaaggatacctgagcgccctgagaaccggctggtacacctccgtcatcaccatagaactctccaacatcaaagaaaacaaatgcaacggtacggacgccaaagttaaactcatcaaacaagaacttgacaaatacaagaacgccgtcacagaactgcaactcctcatgcaatccacccccgccgccggctccggctccgccatagcctccggcatcgccgtctgcaaagtcttacacctagaaggcgaagtcaacaaaatcaaaaacgcactactttccacaaacaaagccgtcgtctcactctccaacggcgtatccgtcctcaccttcaaagtacttgacctcaaaaactacatcgacaaacaactactccccatcctgaacaaacaatcctgctcaatctccaacatcgaaaccgtaatcgagttccaacagaaaaataatcgcctcctggagatcacccgcgagttctccgtcaatgcaggagtcacaaccccagtatcaacctacatgctcaccaactccgaactcctgtcgctcatcaacgacatgcccatcacaaacgaccaaaagaaactcatgtccaacaacgtacaaatcgtcagacaacaatcctattctataatgtgcatcatcaaagaagaagtcctcgcctacgtcgtacaactccccctctacggcgttatcgacaccccctgctggaaactccacacctcacccctctgcaccaccaacacaaaagaaggctccaacatctgcctcactcggaccgaccgcggctggtactgcgacaatgccggcagcgtctccttcttcccacaagccgaaacctgcaaagtccagtccaaccgcgtattctgcgacactatgaactccagaaccctcccctccgaagtaaacctctgcaacatcgacatcttcaacccaaaatacgactgcaaaatcatgacctcaaaaaccgacgtcagctcgtcagtcataaccagcctcggagccatagtctcatgctacggaaaaaccaaatgcaccgccagcaacaaaaaccgcggcataataaaaacattctccaacggctgcgactatgtatccaacaaaggagtcgataccgtctccgtaggcaacaccctatactacgtcaacaaacaagaaggcaaatccctctacgtcaaaggtgaaccaatcatcaacttctacgaccctctcgtcttcccctccgatgagttcgacgcctcaatcagccaagtaaacgaaaagataaaccaatcactcgccttcatccgcaaatccgacgaacttcttcacaacgtcaacgtcggcaaatctaccaccaacataatgataaccaccatcatcatcgtcatcatcgtaatactcctccttctcatcgccgtcggcctattcctatactgcaaagcccgctagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13844 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut0 (opt1)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13845 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut0 (opt1)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13846 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut0 (opt2)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13847 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut0 (opt3)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13848 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut0 (opt4)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13849 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut0 (opt5)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13850 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut0 (opt6)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggaactcccaatacttaaaacaaacgcaatcacaacaatactagctgcagtcacactatgcttcgcctcatcacaaaatataacagaagaattttatcaatcaacatgctccgcagtatcaaaaggatatctctctgcattacgaacaggttggtacacctcggtaataacaatagaattatcaaacataaaagaaaataaatgcaatggaaccgatgccaaagtaaaactaatcaaacaagaacttgacaaatacaaaaacgcagtaacagaactacaactattaatgcaatcaacaccagcagcaggttcaggctccgcaatcgcttcaggaatagccgtttgtaaagtactacacttagaaggagaagtaaataaaataaaaaacgccttactatcaacaaacaaagcagtagtctccctttccaacggagtatcagtcttaacttttaaagtactcgacttaaaaaattacatcgacaaacaactactacccattctaaataaacaatcatgctcaatatcaaacatcgaaacagtaatcgaatttcaacaaaaaaataatagattactagaaataacacgagaattttccgtaaatgccggagtaacgaccccagtctcaacatacatgttaacaaactcagaattactatcactcattaacgatatgccaataacaaatgaccaaaaaaaactaatgtcaaacaacgtccaaatagtacgacaacaatcatactctatcatgtgtataataaaagaagaagttttagcatacgtagtacaactaccactttacggagtcatagacaccccatgctggaaactacacacatcacccttatgtacaacaaacaccaaagaagggtctaacatatgtctcactagaacagatcgaggctggtactgcgacaacgcaggatcagttagctttttccctcaagccgaaacctgtaaagtacaatccaatcgagtattttgcgacactatgaactctagaaccttaccctccgaagtaaacctatgtaacatagacatatttaatcccaaatatgattgcaaaatcatgacatccaaaacagatgtatcaagctctgtaataacctcactaggagcaatagtttcatgctatggtaaaacaaaatgcaccgcctcaaacaaaaatagagggataatcaaaaccttctcaaatggatgcgactacgtatcaaataaaggagtagacaccgtctccgtaggaaacacactatactacgtaaacaaacaagaaggaaaatcactatacgtaaaaggagaaccaatcataaacttctacgacccacttgttttcccatcagatgaatttgatgcctccatatcacaagtaaacgaaaaaataaaccaatctctagccttcatcagaaaatccgacgaacttttacacaacgtaaacgtaggtaaatcaacaaccaacatcatgataacaacaataataatagtaataattgtaatacttttactacttatcgccgtaggcctattcttatattgtaaagcaagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13851 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut0 (opt11)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggaactaccaatcctcaaaaccaacgccatcactacaatcctagccgcggtaaccctgtgcttcgcctcctcacaaaacatcacagaagaattttaccaatcaacctgctccgccgtatccaaaggatacctgagcgccctgagaaccggctggtacacctccgtcatcaccatagaactctccaacatcaaagaaaacaaatgcaacggtacggacgccaaagttaaactcatcaaacaagaacttgacaaatacaagaacgccgtcacagaactgcaactcctcatgcaatccacccccgccgccggctccggctccgccatagcctccggcatcgccgtctgcaaagtcttacacctagaaggcgaagtcaacaaaatcaaaaacgcactactttccacaaacaaagccgtcgtctcactctccaacggcgtatccgtcctcaccttcaaagtacttgacctcaaaaactacatcgacaaacaactactccccatcctgaacaaacaatcctgctcaatctccaacatcgaaaccgtaatcgagttccaacagaaaaataatcgcctcctggagatcacccgcgagttctccgtcaatgcaggagtcacaaccccagtatcaacctacatgctcaccaactccgaactcctgtcgctcatcaacgacatgcccatcacaaacgaccaaaagaaactcatgtccaacaacgtacaaatcgtcagacaacaatcctattctataatgtgcatcatcaaagaagaagtcctcgcctacgtcgtacaactccccctctacggcgttatcgacaccccctgctggaaactccacacctcacccctctgcaccaccaacacaaaagaaggctccaacatctgcctcactcggaccgaccgcggctggtactgcgacaatgccggcagcgtctccttcttcccacaagccgaaacctgcaaagtccagtccaaccgcgtattctgcgacactatgaactccagaaccctcccctccgaagtaaacctctgcaacatcgacatcttcaacccaaaatacgactgcaaaatcatgacctcaaaaaccgacgtcagctcgtcagtcataaccagcctcggagccatagtctcatgctacggaaaaaccaaatgcaccgccagcaacaaaaaccgcggcataataaaaacattctccaacggctgcgactatgtatccaacaaaggagtcgataccgtctccgtaggcaacaccctatactacgtcaacaaacaagaaggcaaatccctctacgtcaaaggtgaaccaatcatcaacttctacgaccctctcgtcttcccctccgatgagttcgacgcctcaatcagccaagtaaacgaaaagataaaccaatcactcgccttcatccgcaaatccgacgaacttcttcacaacgtcaacgtcggcaaatctaccaccaacataatgataaccaccatcatcatcgtcatcatcgtaatactcctccttctcatcgccgtcggcctattcctatactgcaaagcccgctagggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13852 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut0 (opt1)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13853 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut0 (opt1)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13854 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut0 (opt2)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13855 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut0 (opt3)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13856 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut0 (opt4)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13857 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut0 (opt5)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13858 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut0 (opt6)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcccaatacttaaaacaaacgcaatcacaacaatactagctgcagtcacactatgcttcgcctcatcacaaaatataacagaagaattttatcaatcaacatgctccgcagtatcaaaaggatatctctctgcattacgaacaggttggtacacctcggtaataacaatagaattatcaaacataaaagaaaataaatgcaatggaaccgatgccaaagtaaaactaatcaaacaagaacttgacaaatacaaaaacgcagtaacagaactacaactattaatgcaatcaacaccagcagcaggttcaggctccgcaatcgcttcaggaatagccgtttgtaaagtactacacttagaaggagaagtaaataaaataaaaaacgccttactatcaacaaacaaagcagtagtctccctttccaacggagtatcagtcttaacttttaaagtactcgacttaaaaaattacatcgacaaacaactactacccattctaaataaacaatcatgctcaatatcaaacatcgaaacagtaatcgaatttcaacaaaaaaataatagattactagaaataacacgagaattttccgtaaatgccggagtaacgaccccagtctcaacatacatgttaacaaactcagaattactatcactcattaacgatatgccaataacaaatgaccaaaaaaaactaatgtcaaacaacgtccaaatagtacgacaacaatcatactctatcatgtgtataataaaagaagaagttttagcatacgtagtacaactaccactttacggagtcatagacaccccatgctggaaactacacacatcacccttatgtacaacaaacaccaaagaagggtctaacatatgtctcactagaacagatcgaggctggtactgcgacaacgcaggatcagttagctttttccctcaagccgaaacctgtaaagtacaatccaatcgagtattttgcgacactatgaactctagaaccttaccctccgaagtaaacctatgtaacatagacatatttaatcccaaatatgattgcaaaatcatgacatccaaaacagatgtatcaagctctgtaataacctcactaggagcaatagtttcatgctatggtaaaacaaaatgcaccgcctcaaacaaaaatagagggataatcaaaaccttctcaaatggatgcgactacgtatcaaataaaggagtagacaccgtctccgtaggaaacacactatactacgtaaacaaacaagaaggaaaatcactatacgtaaaaggagaaccaatcataaacttctacgacccacttgttttcccatcagatgaatttgatgcctccatatcacaagtaaacgaaaaaataaaccaatctctagccttcatcagaaaatccgacgaacttttacacaacgtaaacgtaggtaaatcaacaaccaacatcatgataacaacaataataatagtaataattgtaatacttttactacttatcgccgtaggcctattcttatattgtaaagcaagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13859 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut0 (opt11)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactaccaatcctcaaaaccaacgccatcactacaatcctagccgcggtaaccctgtgcttcgcctcctcacaaaacatcacagaagaattttaccaatcaacctgctccgccgtatccaaaggatacctgagcgccctgagaaccggctggtacacctccgtcatcaccatagaactctccaacatcaaagaaaacaaatgcaacggtacggacgccaaagttaaactcatcaaacaagaacttgacaaatacaagaacgccgtcacagaactgcaactcctcatgcaatccacccccgccgccggctccggctccgccatagcctccggcatcgccgtctgcaaagtcttacacctagaaggcgaagtcaacaaaatcaaaaacgcactactttccacaaacaaagccgtcgtctcactctccaacggcgtatccgtcctcaccttcaaagtacttgacctcaaaaactacatcgacaaacaactactccccatcctgaacaaacaatcctgctcaatctccaacatcgaaaccgtaatcgagttccaacagaaaaataatcgcctcctggagatcacccgcgagttctccgtcaatgcaggagtcacaaccccagtatcaacctacatgctcaccaactccgaactcctgtcgctcatcaacgacatgcccatcacaaacgaccaaaagaaactcatgtccaacaacgtacaaatcgtcagacaacaatcctattctataatgtgcatcatcaaagaagaagtcctcgcctacgtcgtacaactccccctctacggcgttatcgacaccccctgctggaaactccacacctcacccctctgcaccaccaacacaaaagaaggctccaacatctgcctcactcggaccgaccgcggctggtactgcgacaatgccggcagcgtctccttcttcccacaagccgaaacctgcaaagtccagtccaaccgcgtattctgcgacactatgaactccagaaccctcccctccgaagtaaacctctgcaacatcgacatcttcaacccaaaatacgactgcaaaatcatgacctcaaaaaccgacgtcagctcgtcagtcataaccagcctcggagccatagtctcatgctacggaaaaaccaaatgcaccgccagcaacaaaaaccgcggcataataaaaacattctccaacggctgcgactatgtatccaacaaaggagtcgataccgtctccgtaggcaacaccctatactacgtcaacaaacaagaaggcaaatccctctacgtcaaaggtgaaccaatcatcaacttctacgaccctctcgtcttcccctccgatgagttcgacgcctcaatcagccaagtaaacgaaaagataaaccaatcactcgccttcatccgcaaatccgacgaacttcttcacaacgtcaacgtcggcaaatctaccaccaacataatgataaccaccatcatcatcgtcatcatcgtaatactcctccttctcatcgccgtcggcctattcctatactgcaaagcccgctagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13860 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut0 (opt1)
  source 1..1907: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13861 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut0 (opt1)
  source 1..1907: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13862 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut0 (opt2)
  source 1..1907: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13863 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut0 (opt3)
  source 1..1907: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13864 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut0 (opt4)
  source 1..1907: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13865 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut0 (opt5)
  source 1..1907: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13866 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut0 (opt6)
  source 1..1907: mol_type = other RNA
gggagacccgtgacccggaagttgtacggctacgcgactttccctcccacaaaccctcgcgcccttcctttcctacttgggcccggcagaaagcttaccatggaactcccaatacttaaaacaaacgcaatcacaacaatactagctgcagtcacactatgcttcgcctcatcacaaaatataacagaagaattttatcaatcaacatgctccgcagtatcaaaaggatatctctctgcattacgaacaggttggtacacctcggtaataacaatagaattatcaaacataaaagaaaataaatgcaatggaaccgatgccaaagtaaaactaatcaaacaagaacttgacaaatacaaaaacgcagtaacagaactacaactattaatgcaatcaacaccagcagcaggttcaggctccgcaatcgcttcaggaatagccgtttgtaaagtactacacttagaaggagaagtaaataaaataaaaaacgccttactatcaacaaacaaagcagtagtctccctttccaacggagtatcagtcttaacttttaaagtactcgacttaaaaaattacatcgacaaacaactactacccattctaaataaacaatcatgctcaatatcaaacatcgaaacagtaatcgaatttcaacaaaaaaataatagattactagaaataacacgagaattttccgtaaatgccggagtaacgaccccagtctcaacatacatgttaacaaactcagaattactatcactcattaacgatatgccaataacaaatgaccaaaaaaaactaatgtcaaacaacgtccaaatagtacgacaacaatcatactctatcatgtgtataataaaagaagaagttttagcatacgtagtacaactaccactttacggagtcatagacaccccatgctggaaactacacacatcacccttatgtacaacaaacaccaaagaagggtctaacatatgtctcactagaacagatcgaggctggtactgcgacaacgcaggatcagttagctttttccctcaagccgaaacctgtaaagtacaatccaatcgagtattttgcgacactatgaactctagaaccttaccctccgaagtaaacctatgtaacatagacatatttaatcccaaatatgattgcaaaatcatgacatccaaaacagatgtatcaagctctgtaataacctcactaggagcaatagtttcatgctatggtaaaacaaaatgcaccgcctcaaacaaaaatagagggataatcaaaaccttctcaaatggatgcgactacgtatcaaataaaggagtagacaccgtctccgtaggaaacacactatactacgtaaacaaacaagaaggaaaatcactatacgtaaaaggagaaccaatcataaacttctacgacccacttgttttcccatcagatgaatttgatgcctccatatcacaagtaaacgaaaaaataaaccaatctctagccttcatcagaaaatccgacgaacttttacacaacgtaaacgtaggtaaatcaacaaccaacatcatgataacaacaataataatagtaataattgtaatacttttactacttatcgccgtaggcctattcttatattgtaaagcaagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13867 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut0 (opt11)
  source 1..1907: mol_type = other RNA
gggagacccgtgacccggaagttgtacggctacgcgactttccctcccacaaaccctcgcgcccttcctttcctacttgggcccggcagaaagcttaccatggaactaccaatcctcaaaaccaacgccatcactacaatcctagccgcggtaaccctgtgcttcgcctcctcacaaaacatcacagaagaattttaccaatcaacctgctccgccgtatccaaaggatacctgagcgccctgagaaccggctggtacacctccgtcatcaccatagaactctccaacatcaaagaaaacaaatgcaacggtacggacgccaaagttaaactcatcaaacaagaacttgacaaatacaagaacgccgtcacagaactgcaactcctcatgcaatccacccccgccgccggctccggctccgccatagcctccggcatcgccgtctgcaaagtcttacacctagaaggcgaagtcaacaaaatcaaaaacgcactactttccacaaacaaagccgtcgtctcactctccaacggcgtatccgtcctcaccttcaaagtacttgacctcaaaaactacatcgacaaacaactactccccatcctgaacaaacaatcctgctcaatctccaacatcgaaaccgtaatcgagttccaacagaaaaataatcgcctcctggagatcacccgcgagttctccgtcaatgcaggagtcacaaccccagtatcaacctacatgctcaccaactccgaactcctgtcgctcatcaacgacatgcccatcacaaacgaccaaaagaaactcatgtccaacaacgtacaaatcgtcagacaacaatcctattctataatgtgcatcatcaaagaagaagtcctcgcctacgtcgtacaactccccctctacggcgttatcgacaccccctgctggaaactccacacctcacccctctgcaccaccaacacaaaagaaggctccaacatctgcctcactcggaccgaccgcggctggtactgcgacaatgccggcagcgtctccttcttcccacaagccgaaacctgcaaagtccagtccaaccgcgtattctgcgacactatgaactccagaaccctcccctccgaagtaaacctctgcaacatcgacatcttcaacccaaaatacgactgcaaaatcatgacctcaaaaaccgacgtcagctcgtcagtcataaccagcctcggagccatagtctcatgctacggaaaaaccaaatgcaccgccagcaacaaaaaccgcggcataataaaaacattctccaacggctgcgactatgtatccaacaaaggagtcgataccgtctccgtaggcaacaccctatactacgtcaacaaacaagaaggcaaatccctctacgtcaaaggtgaaccaatcatcaacttctacgaccctctcgtcttcccctccgatgagttcgacgcctcaatcagccaagtaaacgaaaagataaaccaatcactcgccttcatccgcaaatccgacgaacttcttcacaacgtcaacgtcggcaaatctaccaccaacataatgataaccaccatcatcatcgtcatcatcgtaatactcctccttctcatcgccgtcggcctattcctatactgcaaagcccgctagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13868 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut0 (opt1)
  source 1..1923: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13869 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut0 (opt1)
  source 1..1923: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13870 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut0 (opt2)
  source 1..1923: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13871 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut0 (opt3)
  source 1..1923: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13872 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut0 (opt4)
  source 1..1923: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13873 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut0 (opt5)
  source 1..1923: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13874 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut0 (opt6)
  source 1..1923: mol_type = other RNA
gggagacccgtgacccggaagttgtacggctacgcgactttccctcccacaaaccctcgcgcccttcctttcctacttgggcccggcagaaagcttaccatggaactcccaatacttaaaacaaacgcaatcacaacaatactagctgcagtcacactatgcttcgcctcatcacaaaatataacagaagaattttatcaatcaacatgctccgcagtatcaaaaggatatctctctgcattacgaacaggttggtacacctcggtaataacaatagaattatcaaacataaaagaaaataaatgcaatggaaccgatgccaaagtaaaactaatcaaacaagaacttgacaaatacaaaaacgcagtaacagaactacaactattaatgcaatcaacaccagcagcaggttcaggctccgcaatcgcttcaggaatagccgtttgtaaagtactacacttagaaggagaagtaaataaaataaaaaacgccttactatcaacaaacaaagcagtagtctccctttccaacggagtatcagtcttaacttttaaagtactcgacttaaaaaattacatcgacaaacaactactacccattctaaataaacaatcatgctcaatatcaaacatcgaaacagtaatcgaatttcaacaaaaaaataatagattactagaaataacacgagaattttccgtaaatgccggagtaacgaccccagtctcaacatacatgttaacaaactcagaattactatcactcattaacgatatgccaataacaaatgaccaaaaaaaactaatgtcaaacaacgtccaaatagtacgacaacaatcatactctatcatgtgtataataaaagaagaagttttagcatacgtagtacaactaccactttacggagtcatagacaccccatgctggaaactacacacatcacccttatgtacaacaaacaccaaagaagggtctaacatatgtctcactagaacagatcgaggctggtactgcgacaacgcaggatcagttagctttttccctcaagccgaaacctgtaaagtacaatccaatcgagtattttgcgacactatgaactctagaaccttaccctccgaagtaaacctatgtaacatagacatatttaatcccaaatatgattgcaaaatcatgacatccaaaacagatgtatcaagctctgtaataacctcactaggagcaatagtttcatgctatggtaaaacaaaatgcaccgcctcaaacaaaaatagagggataatcaaaaccttctcaaatggatgcgactacgtatcaaataaaggagtagacaccgtctccgtaggaaacacactatactacgtaaacaaacaagaaggaaaatcactatacgtaaaaggagaaccaatcataaacttctacgacccacttgttttcccatcagatgaatttgatgcctccatatcacaagtaaacgaaaaaataaaccaatctctagccttcatcagaaaatccgacgaacttttacacaacgtaaacgtaggtaaatcaacaaccaacatcatgataacaacaataataatagtaataattgtaatacttttactacttatcgccgtaggcctattcttatattgtaaagcaagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13875 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut0 (opt11)
  source 1..1923: mol_type = other RNA
gggagacccgtgacccggaagttgtacggctacgcgactttccctcccacaaaccctcgcgcccttcctttcctacttgggcccggcagaaagcttaccatggaactaccaatcctcaaaaccaacgccatcactacaatcctagccgcggtaaccctgtgcttcgcctcctcacaaaacatcacagaagaattttaccaatcaacctgctccgccgtatccaaaggatacctgagcgccctgagaaccggctggtacacctccgtcatcaccatagaactctccaacatcaaagaaaacaaatgcaacggtacggacgccaaagttaaactcatcaaacaagaacttgacaaatacaagaacgccgtcacagaactgcaactcctcatgcaatccacccccgccgccggctccggctccgccatagcctccggcatcgccgtctgcaaagtcttacacctagaaggcgaagtcaacaaaatcaaaaacgcactactttccacaaacaaagccgtcgtctcactctccaacggcgtatccgtcctcaccttcaaagtacttgacctcaaaaactacatcgacaaacaactactccccatcctgaacaaacaatcctgctcaatctccaacatcgaaaccgtaatcgagttccaacagaaaaataatcgcctcctggagatcacccgcgagttctccgtcaatgcaggagtcacaaccccagtatcaacctacatgctcaccaactccgaactcctgtcgctcatcaacgacatgcccatcacaaacgaccaaaagaaactcatgtccaacaacgtacaaatcgtcagacaacaatcctattctataatgtgcatcatcaaagaagaagtcctcgcctacgtcgtacaactccccctctacggcgttatcgacaccccctgctggaaactccacacctcacccctctgcaccaccaacacaaaagaaggctccaacatctgcctcactcggaccgaccgcggctggtactgcgacaatgccggcagcgtctccttcttcccacaagccgaaacctgcaaagtccagtccaaccgcgtattctgcgacactatgaactccagaaccctcccctccgaagtaaacctctgcaacatcgacatcttcaacccaaaatacgactgcaaaatcatgacctcaaaaaccgacgtcagctcgtcagtcataaccagcctcggagccatagtctcatgctacggaaaaaccaaatgcaccgccagcaacaaaaaccgcggcataataaaaacattctccaacggctgcgactatgtatccaacaaaggagtcgataccgtctccgtaggcaacaccctatactacgtcaacaaacaagaaggcaaatccctctacgtcaaaggtgaaccaatcatcaacttctacgaccctctcgtcttcccctccgatgagttcgacgcctcaatcagccaagtaaacgaaaagataaaccaatcactcgccttcatccgcaaatccgacgaacttcttcacaacgtcaacgtcggcaaatctaccaccaacataatgataaccaccatcatcatcgtcatcatcgtaatactcctccttctcatcgccgtcggcctattcctatactgcaaagcccgctagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13876 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut0 (opt1)
  source 1..2139: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13877 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut0 (opt1)
  source 1..2139: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13878 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut0 (opt2)
  source 1..2139: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13879 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut0 (opt3)
  source 1..2139: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13880 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut0 (opt4)
  source 1..2139: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13881 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut0 (opt5)
  source 1..2139: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13882 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut0 (opt6)
  source 1..2139: mol_type = other RNA
gggagacccgtgacccggaagttgtacggctacgcgactttccctcccacaaaccctcgcgcccttcctttcctacttgggcccggcagaaagcttaccatggaactcccaatacttaaaacaaacgcaatcacaacaatactagctgcagtcacactatgcttcgcctcatcacaaaatataacagaagaattttatcaatcaacatgctccgcagtatcaaaaggatatctctctgcattacgaacaggttggtacacctcggtaataacaatagaattatcaaacataaaagaaaataaatgcaatggaaccgatgccaaagtaaaactaatcaaacaagaacttgacaaatacaaaaacgcagtaacagaactacaactattaatgcaatcaacaccagcagcaggttcaggctccgcaatcgcttcaggaatagccgtttgtaaagtactacacttagaaggagaagtaaataaaataaaaaacgccttactatcaacaaacaaagcagtagtctccctttccaacggagtatcagtcttaacttttaaagtactcgacttaaaaaattacatcgacaaacaactactacccattctaaataaacaatcatgctcaatatcaaacatcgaaacagtaatcgaatttcaacaaaaaaataatagattactagaaataacacgagaattttccgtaaatgccggagtaacgaccccagtctcaacatacatgttaacaaactcagaattactatcactcattaacgatatgccaataacaaatgaccaaaaaaaactaatgtcaaacaacgtccaaatagtacgacaacaatcatactctatcatgtgtataataaaagaagaagttttagcatacgtagtacaactaccactttacggagtcatagacaccccatgctggaaactacacacatcacccttatgtacaacaaacaccaaagaagggtctaacatatgtctcactagaacagatcgaggctggtactgcgacaacgcaggatcagttagctttttccctcaagccgaaacctgtaaagtacaatccaatcgagtattttgcgacactatgaactctagaaccttaccctccgaagtaaacctatgtaacatagacatatttaatcccaaatatgattgcaaaatcatgacatccaaaacagatgtatcaagctctgtaataacctcactaggagcaatagtttcatgctatggtaaaacaaaatgcaccgcctcaaacaaaaatagagggataatcaaaaccttctcaaatggatgcgactacgtatcaaataaaggagtagacaccgtctccgtaggaaacacactatactacgtaaacaaacaagaaggaaaatcactatacgtaaaaggagaaccaatcataaacttctacgacccacttgttttcccatcagatgaatttgatgcctccatatcacaagtaaacgaaaaaataaaccaatctctagccttcatcagaaaatccgacgaacttttacacaacgtaaacgtaggtaaatcaacaaccaacatcatgataacaacaataataatagtaataattgtaatacttttactacttatcgccgtaggcctattcttatattgtaaagcaagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13883 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut0 (opt11)
  source 1..2139: mol_type = other RNA
gggagacccgtgacccggaagttgtacggctacgcgactttccctcccacaaaccctcgcgcccttcctttcctacttgggcccggcagaaagcttaccatggaactaccaatcctcaaaaccaacgccatcactacaatcctagccgcggtaaccctgtgcttcgcctcctcacaaaacatcacagaagaattttaccaatcaacctgctccgccgtatccaaaggatacctgagcgccctgagaaccggctggtacacctccgtcatcaccatagaactctccaacatcaaagaaaacaaatgcaacggtacggacgccaaagttaaactcatcaaacaagaacttgacaaatacaagaacgccgtcacagaactgcaactcctcatgcaatccacccccgccgccggctccggctccgccatagcctccggcatcgccgtctgcaaagtcttacacctagaaggcgaagtcaacaaaatcaaaaacgcactactttccacaaacaaagccgtcgtctcactctccaacggcgtatccgtcctcaccttcaaagtacttgacctcaaaaactacatcgacaaacaactactccccatcctgaacaaacaatcctgctcaatctccaacatcgaaaccgtaatcgagttccaacagaaaaataatcgcctcctggagatcacccgcgagttctccgtcaatgcaggagtcacaaccccagtatcaacctacatgctcaccaactccgaactcctgtcgctcatcaacgacatgcccatcacaaacgaccaaaagaaactcatgtccaacaacgtacaaatcgtcagacaacaatcctattctataatgtgcatcatcaaagaagaagtcctcgcctacgtcgtacaactccccctctacggcgttatcgacaccccctgctggaaactccacacctcacccctctgcaccaccaacacaaaagaaggctccaacatctgcctcactcggaccgaccgcggctggtactgcgacaatgccggcagcgtctccttcttcccacaagccgaaacctgcaaagtccagtccaaccgcgtattctgcgacactatgaactccagaaccctcccctccgaagtaaacctctgcaacatcgacatcttcaacccaaaatacgactgcaaaatcatgacctcaaaaaccgacgtcagctcgtcagtcataaccagcctcggagccatagtctcatgctacggaaaaaccaaatgcaccgccagcaacaaaaaccgcggcataataaaaacattctccaacggctgcgactatgtatccaacaaaggagtcgataccgtctccgtaggcaacaccctatactacgtcaacaaacaagaaggcaaatccctctacgtcaaaggtgaaccaatcatcaacttctacgaccctctcgtcttcccctccgatgagttcgacgcctcaatcagccaagtaaacgaaaagataaaccaatcactcgccttcatccgcaaatccgacgaacttcttcacaacgtcaacgtcggcaaatctaccaccaacataatgataaccaccatcatcatcgtcatcatcgtaatactcctccttctcatcgccgtcggcctattcctatactgcaaagcccgctagggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13884 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut0 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13885 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut0 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13886 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut0 (opt2)
  source 1..1919: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13887 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut0 (opt3)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13888 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut0 (opt4)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13889 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut0 (opt5)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13890 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut0 (opt6)
  source 1..1919: mol_type = other RNA
gggagacccgtgacccggaagttgtacggctacgcgactttccctcccacaaaccctcgcgcccttcctttcctacttgggcccggcagaaagcttaccatggaactcccaatacttaaaacaaacgcaatcacaacaatactagctgcagtcacactatgcttcgcctcatcacaaaatataacagaagaattttatcaatcaacatgctccgcagtatcaaaaggatatctctctgcattacgaacaggttggtacacctcggtaataacaatagaattatcaaacataaaagaaaataaatgcaatggaaccgatgccaaagtaaaactaatcaaacaagaacttgacaaatacaaaaacgcagtaacagaactacaactattaatgcaatcaacaccagcagcaggttcaggctccgcaatcgcttcaggaatagccgtttgtaaagtactacacttagaaggagaagtaaataaaataaaaaacgccttactatcaacaaacaaagcagtagtctccctttccaacggagtatcagtcttaacttttaaagtactcgacttaaaaaattacatcgacaaacaactactacccattctaaataaacaatcatgctcaatatcaaacatcgaaacagtaatcgaatttcaacaaaaaaataatagattactagaaataacacgagaattttccgtaaatgccggagtaacgaccccagtctcaacatacatgttaacaaactcagaattactatcactcattaacgatatgccaataacaaatgaccaaaaaaaactaatgtcaaacaacgtccaaatagtacgacaacaatcatactctatcatgtgtataataaaagaagaagttttagcatacgtagtacaactaccactttacggagtcatagacaccccatgctggaaactacacacatcacccttatgtacaacaaacaccaaagaagggtctaacatatgtctcactagaacagatcgaggctggtactgcgacaacgcaggatcagttagctttttccctcaagccgaaacctgtaaagtacaatccaatcgagtattttgcgacactatgaactctagaaccttaccctccgaagtaaacctatgtaacatagacatatttaatcccaaatatgattgcaaaatcatgacatccaaaacagatgtatcaagctctgtaataacctcactaggagcaatagtttcatgctatggtaaaacaaaatgcaccgcctcaaacaaaaatagagggataatcaaaaccttctcaaatggatgcgactacgtatcaaataaaggagtagacaccgtctccgtaggaaacacactatactacgtaaacaaacaagaaggaaaatcactatacgtaaaaggagaaccaatcataaacttctacgacccacttgttttcccatcagatgaatttgatgcctccatatcacaagtaaacgaaaaaataaaccaatctctagccttcatcagaaaatccgacgaacttttacacaacgtaaacgtaggtaaatcaacaaccaacatcatgataacaacaataataatagtaataattgtaatacttttactacttatcgccgtaggcctattcttatattgtaaagcaagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13891 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut0 (opt11)
  source 1..1919: mol_type = other RNA
gggagacccgtgacccggaagttgtacggctacgcgactttccctcccacaaaccctcgcgcccttcctttcctacttgggcccggcagaaagcttaccatggaactaccaatcctcaaaaccaacgccatcactacaatcctagccgcggtaaccctgtgcttcgcctcctcacaaaacatcacagaagaattttaccaatcaacctgctccgccgtatccaaaggatacctgagcgccctgagaaccggctggtacacctccgtcatcaccatagaactctccaacatcaaagaaaacaaatgcaacggtacggacgccaaagttaaactcatcaaacaagaacttgacaaatacaagaacgccgtcacagaactgcaactcctcatgcaatccacccccgccgccggctccggctccgccatagcctccggcatcgccgtctgcaaagtcttacacctagaaggcgaagtcaacaaaatcaaaaacgcactactttccacaaacaaagccgtcgtctcactctccaacggcgtatccgtcctcaccttcaaagtacttgacctcaaaaactacatcgacaaacaactactccccatcctgaacaaacaatcctgctcaatctccaacatcgaaaccgtaatcgagttccaacagaaaaataatcgcctcctggagatcacccgcgagttctccgtcaatgcaggagtcacaaccccagtatcaacctacatgctcaccaactccgaactcctgtcgctcatcaacgacatgcccatcacaaacgaccaaaagaaactcatgtccaacaacgtacaaatcgtcagacaacaatcctattctataatgtgcatcatcaaagaagaagtcctcgcctacgtcgtacaactccccctctacggcgttatcgacaccccctgctggaaactccacacctcacccctctgcaccaccaacacaaaagaaggctccaacatctgcctcactcggaccgaccgcggctggtactgcgacaatgccggcagcgtctccttcttcccacaagccgaaacctgcaaagtccagtccaaccgcgtattctgcgacactatgaactccagaaccctcccctccgaagtaaacctctgcaacatcgacatcttcaacccaaaatacgactgcaaaatcatgacctcaaaaaccgacgtcagctcgtcagtcataaccagcctcggagccatagtctcatgctacggaaaaaccaaatgcaccgccagcaacaaaaaccgcggcataataaaaacattctccaacggctgcgactatgtatccaacaaaggagtcgataccgtctccgtaggcaacaccctatactacgtcaacaaacaagaaggcaaatccctctacgtcaaaggtgaaccaatcatcaacttctacgaccctctcgtcttcccctccgatgagttcgacgcctcaatcagccaagtaaacgaaaagataaaccaatcactcgccttcatccgcaaatccgacgaacttcttcacaacgtcaacgtcggcaaatctaccaccaacataatgataaccaccatcatcatcgtcatcatcgtaatactcctccttctcatcgccgtcggcctattcctatactgcaaagcccgctagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13892 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut0 (opt1)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13893 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut0 (opt1)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13894 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut0 (opt2)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13895 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut0 (opt3)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13896 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut0 (opt4)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13897 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut0 (opt5)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13898 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut0 (opt6)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccaatacttaaaacaaacgcaatcacaacaatactagctgcagtcacactatgcttcgcctcatcacaaaatataacagaagaattttatcaatcaacatgctccgcagtatcaaaaggatatctctctgcattacgaacaggttggtacacctcggtaataacaatagaattatcaaacataaaagaaaataaatgcaatggaaccgatgccaaagtaaaactaatcaaacaagaacttgacaaatacaaaaacgcagtaacagaactacaactattaatgcaatcaacaccagcagcaggttcaggctccgcaatcgcttcaggaatagccgtttgtaaagtactacacttagaaggagaagtaaataaaataaaaaacgccttactatcaacaaacaaagcagtagtctccctttccaacggagtatcagtcttaacttttaaagtactcgacttaaaaaattacatcgacaaacaactactacccattctaaataaacaatcatgctcaatatcaaacatcgaaacagtaatcgaatttcaacaaaaaaataatagattactagaaataacacgagaattttccgtaaatgccggagtaacgaccccagtctcaacatacatgttaacaaactcagaattactatcactcattaacgatatgccaataacaaatgaccaaaaaaaactaatgtcaaacaacgtccaaatagtacgacaacaatcatactctatcatgtgtataataaaagaagaagttttagcatacgtagtacaactaccactttacggagtcatagacaccccatgctggaaactacacacatcacccttatgtacaacaaacaccaaagaagggtctaacatatgtctcactagaacagatcgaggctggtactgcgacaacgcaggatcagttagctttttccctcaagccgaaacctgtaaagtacaatccaatcgagtattttgcgacactatgaactctagaaccttaccctccgaagtaaacctatgtaacatagacatatttaatcccaaatatgattgcaaaatcatgacatccaaaacagatgtatcaagctctgtaataacctcactaggagcaatagtttcatgctatggtaaaacaaaatgcaccgcctcaaacaaaaatagagggataatcaaaaccttctcaaatggatgcgactacgtatcaaataaaggagtagacaccgtctccgtaggaaacacactatactacgtaaacaaacaagaaggaaaatcactatacgtaaaaggagaaccaatcataaacttctacgacccacttgttttcccatcagatgaatttgatgcctccatatcacaagtaaacgaaaaaataaaccaatctctagccttcatcagaaaatccgacgaacttttacacaacgtaaacgtaggtaaatcaacaaccaacatcatgataacaacaataataatagtaataattgtaatacttttactacttatcgccgtaggcctattcttatattgtaaagcaagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13899 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut0 (opt11)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactaccaatcctcaaaaccaacgccatcactacaatcctagccgcggtaaccctgtgcttcgcctcctcacaaaacatcacagaagaattttaccaatcaacctgctccgccgtatccaaaggatacctgagcgccctgagaaccggctggtacacctccgtcatcaccatagaactctccaacatcaaagaaaacaaatgcaacggtacggacgccaaagttaaactcatcaaacaagaacttgacaaatacaagaacgccgtcacagaactgcaactcctcatgcaatccacccccgccgccggctccggctccgccatagcctccggcatcgccgtctgcaaagtcttacacctagaaggcgaagtcaacaaaatcaaaaacgcactactttccacaaacaaagccgtcgtctcactctccaacggcgtatccgtcctcaccttcaaagtacttgacctcaaaaactacatcgacaaacaactactccccatcctgaacaaacaatcctgctcaatctccaacatcgaaaccgtaatcgagttccaacagaaaaataatcgcctcctggagatcacccgcgagttctccgtcaatgcaggagtcacaaccccagtatcaacctacatgctcaccaactccgaactcctgtcgctcatcaacgacatgcccatcacaaacgaccaaaagaaactcatgtccaacaacgtacaaatcgtcagacaacaatcctattctataatgtgcatcatcaaagaagaagtcctcgcctacgtcgtacaactccccctctacggcgttatcgacaccccctgctggaaactccacacctcacccctctgcaccaccaacacaaaagaaggctccaacatctgcctcactcggaccgaccgcggctggtactgcgacaatgccggcagcgtctccttcttcccacaagccgaaacctgcaaagtccagtccaaccgcgtattctgcgacactatgaactccagaaccctcccctccgaagtaaacctctgcaacatcgacatcttcaacccaaaatacgactgcaaaatcatgacctcaaaaaccgacgtcagctcgtcagtcataaccagcctcggagccatagtctcatgctacggaaaaaccaaatgcaccgccagcaacaaaaaccgcggcataataaaaacattctccaacggctgcgactatgtatccaacaaaggagtcgataccgtctccgtaggcaacaccctatactacgtcaacaaacaagaaggcaaatccctctacgtcaaaggtgaaccaatcatcaacttctacgaccctctcgtcttcccctccgatgagttcgacgcctcaatcagccaagtaaacgaaaagataaaccaatcactcgccttcatccgcaaatccgacgaacttcttcacaacgtcaacgtcggcaaatctaccaccaacataatgataaccaccatcatcatcgtcatcatcgtaatactcctccttctcatcgccgtcggcctattcctatactgcaaagcccgctagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13900 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut0 (opt1)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13901 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut0 (opt1)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13902 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut0 (opt2)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13903 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut0 (opt3)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13904 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut0 (opt4)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13905 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut0 (opt5)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13906 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut0 (opt6)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccaatacttaaaacaaacgcaatcacaacaatactagctgcagtcacactatgcttcgcctcatcacaaaatataacagaagaattttatcaatcaacatgctccgcagtatcaaaaggatatctctctgcattacgaacaggttggtacacctcggtaataacaatagaattatcaaacataaaagaaaataaatgcaatggaaccgatgccaaagtaaaactaatcaaacaagaacttgacaaatacaaaaacgcagtaacagaactacaactattaatgcaatcaacaccagcagcaggttcaggctccgcaatcgcttcaggaatagccgtttgtaaagtactacacttagaaggagaagtaaataaaataaaaaacgccttactatcaacaaacaaagcagtagtctccctttccaacggagtatcagtcttaacttttaaagtactcgacttaaaaaattacatcgacaaacaactactacccattctaaataaacaatcatgctcaatatcaaacatcgaaacagtaatcgaatttcaacaaaaaaataatagattactagaaataacacgagaattttccgtaaatgccggagtaacgaccccagtctcaacatacatgttaacaaactcagaattactatcactcattaacgatatgccaataacaaatgaccaaaaaaaactaatgtcaaacaacgtccaaatagtacgacaacaatcatactctatcatgtgtataataaaagaagaagttttagcatacgtagtacaactaccactttacggagtcatagacaccccatgctggaaactacacacatcacccttatgtacaacaaacaccaaagaagggtctaacatatgtctcactagaacagatcgaggctggtactgcgacaacgcaggatcagttagctttttccctcaagccgaaacctgtaaagtacaatccaatcgagtattttgcgacactatgaactctagaaccttaccctccgaagtaaacctatgtaacatagacatatttaatcccaaatatgattgcaaaatcatgacatccaaaacagatgtatcaagctctgtaataacctcactaggagcaatagtttcatgctatggtaaaacaaaatgcaccgcctcaaacaaaaatagagggataatcaaaaccttctcaaatggatgcgactacgtatcaaataaaggagtagacaccgtctccgtaggaaacacactatactacgtaaacaaacaagaaggaaaatcactatacgtaaaaggagaaccaatcataaacttctacgacccacttgttttcccatcagatgaatttgatgcctccatatcacaagtaaacgaaaaaataaaccaatctctagccttcatcagaaaatccgacgaacttttacacaacgtaaacgtaggtaaatcaacaaccaacatcatgataacaacaataataatagtaataattgtaatacttttactacttatcgccgtaggcctattcttatattgtaaagcaagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13907 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut0 (opt11)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactaccaatcctcaaaaccaacgccatcactacaatcctagccgcggtaaccctgtgcttcgcctcctcacaaaacatcacagaagaattttaccaatcaacctgctccgccgtatccaaaggatacctgagcgccctgagaaccggctggtacacctccgtcatcaccatagaactctccaacatcaaagaaaacaaatgcaacggtacggacgccaaagttaaactcatcaaacaagaacttgacaaatacaagaacgccgtcacagaactgcaactcctcatgcaatccacccccgccgccggctccggctccgccatagcctccggcatcgccgtctgcaaagtcttacacctagaaggcgaagtcaacaaaatcaaaaacgcactactttccacaaacaaagccgtcgtctcactctccaacggcgtatccgtcctcaccttcaaagtacttgacctcaaaaactacatcgacaaacaactactccccatcctgaacaaacaatcctgctcaatctccaacatcgaaaccgtaatcgagttccaacagaaaaataatcgcctcctggagatcacccgcgagttctccgtcaatgcaggagtcacaaccccagtatcaacctacatgctcaccaactccgaactcctgtcgctcatcaacgacatgcccatcacaaacgaccaaaagaaactcatgtccaacaacgtacaaatcgtcagacaacaatcctattctataatgtgcatcatcaaagaagaagtcctcgcctacgtcgtacaactccccctctacggcgttatcgacaccccctgctggaaactccacacctcacccctctgcaccaccaacacaaaagaaggctccaacatctgcctcactcggaccgaccgcggctggtactgcgacaatgccggcagcgtctccttcttcccacaagccgaaacctgcaaagtccagtccaaccgcgtattctgcgacactatgaactccagaaccctcccctccgaagtaaacctctgcaacatcgacatcttcaacccaaaatacgactgcaaaatcatgacctcaaaaaccgacgtcagctcgtcagtcataaccagcctcggagccatagtctcatgctacggaaaaaccaaatgcaccgccagcaacaaaaaccgcggcataataaaaacattctccaacggctgcgactatgtatccaacaaaggagtcgataccgtctccgtaggcaacaccctatactacgtcaacaaacaagaaggcaaatccctctacgtcaaaggtgaaccaatcatcaacttctacgaccctctcgtcttcccctccgatgagttcgacgcctcaatcagccaagtaaacgaaaagataaaccaatcactcgccttcatccgcaaatccgacgaacttcttcacaacgtcaacgtcggcaaatctaccaccaacataatgataaccaccatcatcatcgtcatcatcgtaatactcctccttctcatcgccgtcggcctattcctatactgcaaagcccgctagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13908 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut0 (opt1)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13909 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut0 (opt1)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13910 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut0 (opt2)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13911 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut0 (opt3)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13912 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut0 (opt4)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13913 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut0 (opt5)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13914 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut0 (opt6)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccaatacttaaaacaaacgcaatcacaacaatactagctgcagtcacactatgcttcgcctcatcacaaaatataacagaagaattttatcaatcaacatgctccgcagtatcaaaaggatatctctctgcattacgaacaggttggtacacctcggtaataacaatagaattatcaaacataaaagaaaataaatgcaatggaaccgatgccaaagtaaaactaatcaaacaagaacttgacaaatacaaaaacgcagtaacagaactacaactattaatgcaatcaacaccagcagcaggttcaggctccgcaatcgcttcaggaatagccgtttgtaaagtactacacttagaaggagaagtaaataaaataaaaaacgccttactatcaacaaacaaagcagtagtctccctttccaacggagtatcagtcttaacttttaaagtactcgacttaaaaaattacatcgacaaacaactactacccattctaaataaacaatcatgctcaatatcaaacatcgaaacagtaatcgaatttcaacaaaaaaataatagattactagaaataacacgagaattttccgtaaatgccggagtaacgaccccagtctcaacatacatgttaacaaactcagaattactatcactcattaacgatatgccaataacaaatgaccaaaaaaaactaatgtcaaacaacgtccaaatagtacgacaacaatcatactctatcatgtgtataataaaagaagaagttttagcatacgtagtacaactaccactttacggagtcatagacaccccatgctggaaactacacacatcacccttatgtacaacaaacaccaaagaagggtctaacatatgtctcactagaacagatcgaggctggtactgcgacaacgcaggatcagttagctttttccctcaagccgaaacctgtaaagtacaatccaatcgagtattttgcgacactatgaactctagaaccttaccctccgaagtaaacctatgtaacatagacatatttaatcccaaatatgattgcaaaatcatgacatccaaaacagatgtatcaagctctgtaataacctcactaggagcaatagtttcatgctatggtaaaacaaaatgcaccgcctcaaacaaaaatagagggataatcaaaaccttctcaaatggatgcgactacgtatcaaataaaggagtagacaccgtctccgtaggaaacacactatactacgtaaacaaacaagaaggaaaatcactatacgtaaaaggagaaccaatcataaacttctacgacccacttgttttcccatcagatgaatttgatgcctccatatcacaagtaaacgaaaaaataaaccaatctctagccttcatcagaaaatccgacgaacttttacacaacgtaaacgtaggtaaatcaacaaccaacatcatgataacaacaataataatagtaataattgtaatacttttactacttatcgccgtaggcctattcttatattgtaaagcaagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13915 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut0 (opt11)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactaccaatcctcaaaaccaacgccatcactacaatcctagccgcggtaaccctgtgcttcgcctcctcacaaaacatcacagaagaattttaccaatcaacctgctccgccgtatccaaaggatacctgagcgccctgagaaccggctggtacacctccgtcatcaccatagaactctccaacatcaaagaaaacaaatgcaacggtacggacgccaaagttaaactcatcaaacaagaacttgacaaatacaagaacgccgtcacagaactgcaactcctcatgcaatccacccccgccgccggctccggctccgccatagcctccggcatcgccgtctgcaaagtcttacacctagaaggcgaagtcaacaaaatcaaaaacgcactactttccacaaacaaagccgtcgtctcactctccaacggcgtatccgtcctcaccttcaaagtacttgacctcaaaaactacatcgacaaacaactactccccatcctgaacaaacaatcctgctcaatctccaacatcgaaaccgtaatcgagttccaacagaaaaataatcgcctcctggagatcacccgcgagttctccgtcaatgcaggagtcacaaccccagtatcaacctacatgctcaccaactccgaactcctgtcgctcatcaacgacatgcccatcacaaacgaccaaaagaaactcatgtccaacaacgtacaaatcgtcagacaacaatcctattctataatgtgcatcatcaaagaagaagtcctcgcctacgtcgtacaactccccctctacggcgttatcgacaccccctgctggaaactccacacctcacccctctgcaccaccaacacaaaagaaggctccaacatctgcctcactcggaccgaccgcggctggtactgcgacaatgccggcagcgtctccttcttcccacaagccgaaacctgcaaagtccagtccaaccgcgtattctgcgacactatgaactccagaaccctcccctccgaagtaaacctctgcaacatcgacatcttcaacccaaaatacgactgcaaaatcatgacctcaaaaaccgacgtcagctcgtcagtcataaccagcctcggagccatagtctcatgctacggaaaaaccaaatgcaccgccagcaacaaaaaccgcggcataataaaaacattctccaacggctgcgactatgtatccaacaaaggagtcgataccgtctccgtaggcaacaccctatactacgtcaacaaacaagaaggcaaatccctctacgtcaaaggtgaaccaatcatcaacttctacgaccctctcgtcttcccctccgatgagttcgacgcctcaatcagccaagtaaacgaaaagataaaccaatcactcgccttcatccgcaaatccgacgaacttcttcacaacgtcaacgtcggcaaatctaccaccaacataatgataaccaccatcatcatcgtcatcatcgtaatactcctccttctcatcgccgtcggcctattcctatactgcaaagcccgctagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13916 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut0 (opt1)
  source 1..1931: mol_type = other RNA
gggagaggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13917 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut0 (opt1)
  source 1..1931: mol_type = other RNA
gggagaggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13918 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut0 (opt2)
  source 1..1931: mol_type = other RNA
gggagaggcgctgcctacggaggtggcagccatctccttctcggcatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13919 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut0 (opt3)
  source 1..1931: mol_type = other RNA
gggagaggcgctgcctacggaggtggcagccatctccttctcggcatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13920 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut0 (opt4)
  source 1..1931: mol_type = other RNA
gggagaggcgctgcctacggaggtggcagccatctccttctcggcatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13921 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut0 (opt5)
  source 1..1931: mol_type = other RNA
gggagaggcgctgcctacggaggtggcagccatctccttctcggcatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13922 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut0 (opt6)
  source 1..1931: mol_type = other RNA
gggagaggcgctgcctacggaggtggcagccatctccttctcggcatcaagcttaccatggaactcccaatacttaaaacaaacgcaatcacaacaatactagctgcagtcacactatgcttcgcctcatcacaaaatataacagaagaattttatcaatcaacatgctccgcagtatcaaaaggatatctctctgcattacgaacaggttggtacacctcggtaataacaatagaattatcaaacataaaagaaaataaatgcaatggaaccgatgccaaagtaaaactaatcaaacaagaacttgacaaatacaaaaacgcagtaacagaactacaactattaatgcaatcaacaccagcagcaggttcaggctccgcaatcgcttcaggaatagccgtttgtaaagtactacacttagaaggagaagtaaataaaataaaaaacgccttactatcaacaaacaaagcagtagtctccctttccaacggagtatcagtcttaacttttaaagtactcgacttaaaaaattacatcgacaaacaactactacccattctaaataaacaatcatgctcaatatcaaacatcgaaacagtaatcgaatttcaacaaaaaaataatagattactagaaataacacgagaattttccgtaaatgccggagtaacgaccccagtctcaacatacatgttaacaaactcagaattactatcactcattaacgatatgccaataacaaatgaccaaaaaaaactaatgtcaaacaacgtccaaatagtacgacaacaatcatactctatcatgtgtataataaaagaagaagttttagcatacgtagtacaactaccactttacggagtcatagacaccccatgctggaaactacacacatcacccttatgtacaacaaacaccaaagaagggtctaacatatgtctcactagaacagatcgaggctggtactgcgacaacgcaggatcagttagctttttccctcaagccgaaacctgtaaagtacaatccaatcgagtattttgcgacactatgaactctagaaccttaccctccgaagtaaacctatgtaacatagacatatttaatcccaaatatgattgcaaaatcatgacatccaaaacagatgtatcaagctctgtaataacctcactaggagcaatagtttcatgctatggtaaaacaaaatgcaccgcctcaaacaaaaatagagggataatcaaaaccttctcaaatggatgcgactacgtatcaaataaaggagtagacaccgtctccgtaggaaacacactatactacgtaaacaaacaagaaggaaaatcactatacgtaaaaggagaaccaatcataaacttctacgacccacttgttttcccatcagatgaatttgatgcctccatatcacaagtaaacgaaaaaataaaccaatctctagccttcatcagaaaatccgacgaacttttacacaacgtaaacgtaggtaaatcaacaaccaacatcatgataacaacaataataatagtaataattgtaatacttttactacttatcgccgtaggcctattcttatattgtaaagcaagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13923 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut0 (opt11)
  source 1..1931: mol_type = other RNA
gggagaggcgctgcctacggaggtggcagccatctccttctcggcatcaagcttaccatggaactaccaatcctcaaaaccaacgccatcactacaatcctagccgcggtaaccctgtgcttcgcctcctcacaaaacatcacagaagaattttaccaatcaacctgctccgccgtatccaaaggatacctgagcgccctgagaaccggctggtacacctccgtcatcaccatagaactctccaacatcaaagaaaacaaatgcaacggtacggacgccaaagttaaactcatcaaacaagaacttgacaaatacaagaacgccgtcacagaactgcaactcctcatgcaatccacccccgccgccggctccggctccgccatagcctccggcatcgccgtctgcaaagtcttacacctagaaggcgaagtcaacaaaatcaaaaacgcactactttccacaaacaaagccgtcgtctcactctccaacggcgtatccgtcctcaccttcaaagtacttgacctcaaaaactacatcgacaaacaactactccccatcctgaacaaacaatcctgctcaatctccaacatcgaaaccgtaatcgagttccaacagaaaaataatcgcctcctggagatcacccgcgagttctccgtcaatgcaggagtcacaaccccagtatcaacctacatgctcaccaactccgaactcctgtcgctcatcaacgacatgcccatcacaaacgaccaaaagaaactcatgtccaacaacgtacaaatcgtcagacaacaatcctattctataatgtgcatcatcaaagaagaagtcctcgcctacgtcgtacaactccccctctacggcgttatcgacaccccctgctggaaactccacacctcacccctctgcaccaccaacacaaaagaaggctccaacatctgcctcactcggaccgaccgcggctggtactgcgacaatgccggcagcgtctccttcttcccacaagccgaaacctgcaaagtccagtccaaccgcgtattctgcgacactatgaactccagaaccctcccctccgaagtaaacctctgcaacatcgacatcttcaacccaaaatacgactgcaaaatcatgacctcaaaaaccgacgtcagctcgtcagtcataaccagcctcggagccatagtctcatgctacggaaaaaccaaatgcaccgccagcaacaaaaaccgcggcataataaaaacattctccaacggctgcgactatgtatccaacaaaggagtcgataccgtctccgtaggcaacaccctatactacgtcaacaaacaagaaggcaaatccctctacgtcaaaggtgaaccaatcatcaacttctacgaccctctcgtcttcccctccgatgagttcgacgcctcaatcagccaagtaaacgaaaagataaaccaatcactcgccttcatccgcaaatccgacgaacttcttcacaacgtcaacgtcggcaaatctaccaccaacataatgataaccaccatcatcatcgtcatcatcgtaatactcctccttctcatcgccgtcggcctattcctatactgcaaagcccgctagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13924 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut0 (opt1)
  source 1..1927: mol_type = other RNA
ggggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13925 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut0 (opt1)
  source 1..1927: mol_type = other RNA
ggggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13926 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut0 (opt2)
  source 1..1927: mol_type = other RNA
ggggcgctgcctacggaggtggcagccatctccttctcggcatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13927 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut0 (opt3)
  source 1..1927: mol_type = other RNA
ggggcgctgcctacggaggtggcagccatctccttctcggcatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13928 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut0 (opt4)
  source 1..1927: mol_type = other RNA
ggggcgctgcctacggaggtggcagccatctccttctcggcatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13929 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut0 (opt5)
  source 1..1927: mol_type = other RNA
ggggcgctgcctacggaggtggcagccatctccttctcggcatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13930 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut0 (opt6)
  source 1..1927: mol_type = other RNA
ggggcgctgcctacggaggtggcagccatctccttctcggcatcaagcttaccatggaactcccaatacttaaaacaaacgcaatcacaacaatactagctgcagtcacactatgcttcgcctcatcacaaaatataacagaagaattttatcaatcaacatgctccgcagtatcaaaaggatatctctctgcattacgaacaggttggtacacctcggtaataacaatagaattatcaaacataaaagaaaataaatgcaatggaaccgatgccaaagtaaaactaatcaaacaagaacttgacaaatacaaaaacgcagtaacagaactacaactattaatgcaatcaacaccagcagcaggttcaggctccgcaatcgcttcaggaatagccgtttgtaaagtactacacttagaaggagaagtaaataaaataaaaaacgccttactatcaacaaacaaagcagtagtctccctttccaacggagtatcagtcttaacttttaaagtactcgacttaaaaaattacatcgacaaacaactactacccattctaaataaacaatcatgctcaatatcaaacatcgaaacagtaatcgaatttcaacaaaaaaataatagattactagaaataacacgagaattttccgtaaatgccggagtaacgaccccagtctcaacatacatgttaacaaactcagaattactatcactcattaacgatatgccaataacaaatgaccaaaaaaaactaatgtcaaacaacgtccaaatagtacgacaacaatcatactctatcatgtgtataataaaagaagaagttttagcatacgtagtacaactaccactttacggagtcatagacaccccatgctggaaactacacacatcacccttatgtacaacaaacaccaaagaagggtctaacatatgtctcactagaacagatcgaggctggtactgcgacaacgcaggatcagttagctttttccctcaagccgaaacctgtaaagtacaatccaatcgagtattttgcgacactatgaactctagaaccttaccctccgaagtaaacctatgtaacatagacatatttaatcccaaatatgattgcaaaatcatgacatccaaaacagatgtatcaagctctgtaataacctcactaggagcaatagtttcatgctatggtaaaacaaaatgcaccgcctcaaacaaaaatagagggataatcaaaaccttctcaaatggatgcgactacgtatcaaataaaggagtagacaccgtctccgtaggaaacacactatactacgtaaacaaacaagaaggaaaatcactatacgtaaaaggagaaccaatcataaacttctacgacccacttgttttcccatcagatgaatttgatgcctccatatcacaagtaaacgaaaaaataaaccaatctctagccttcatcagaaaatccgacgaacttttacacaacgtaaacgtaggtaaatcaacaaccaacatcatgataacaacaataataatagtaataattgtaatacttttactacttatcgccgtaggcctattcttatattgtaaagcaagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13931 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut0 (opt11)
  source 1..1927: mol_type = other RNA
ggggcgctgcctacggaggtggcagccatctccttctcggcatcaagcttaccatggaactaccaatcctcaaaaccaacgccatcactacaatcctagccgcggtaaccctgtgcttcgcctcctcacaaaacatcacagaagaattttaccaatcaacctgctccgccgtatccaaaggatacctgagcgccctgagaaccggctggtacacctccgtcatcaccatagaactctccaacatcaaagaaaacaaatgcaacggtacggacgccaaagttaaactcatcaaacaagaacttgacaaatacaagaacgccgtcacagaactgcaactcctcatgcaatccacccccgccgccggctccggctccgccatagcctccggcatcgccgtctgcaaagtcttacacctagaaggcgaagtcaacaaaatcaaaaacgcactactttccacaaacaaagccgtcgtctcactctccaacggcgtatccgtcctcaccttcaaagtacttgacctcaaaaactacatcgacaaacaactactccccatcctgaacaaacaatcctgctcaatctccaacatcgaaaccgtaatcgagttccaacagaaaaataatcgcctcctggagatcacccgcgagttctccgtcaatgcaggagtcacaaccccagtatcaacctacatgctcaccaactccgaactcctgtcgctcatcaacgacatgcccatcacaaacgaccaaaagaaactcatgtccaacaacgtacaaatcgtcagacaacaatcctattctataatgtgcatcatcaaagaagaagtcctcgcctacgtcgtacaactccccctctacggcgttatcgacaccccctgctggaaactccacacctcacccctctgcaccaccaacacaaaagaaggctccaacatctgcctcactcggaccgaccgcggctggtactgcgacaatgccggcagcgtctccttcttcccacaagccgaaacctgcaaagtccagtccaaccgcgtattctgcgacactatgaactccagaaccctcccctccgaagtaaacctctgcaacatcgacatcttcaacccaaaatacgactgcaaaatcatgacctcaaaaaccgacgtcagctcgtcagtcataaccagcctcggagccatagtctcatgctacggaaaaaccaaatgcaccgccagcaacaaaaaccgcggcataataaaaacattctccaacggctgcgactatgtatccaacaaaggagtcgataccgtctccgtaggcaacaccctatactacgtcaacaaacaagaaggcaaatccctctacgtcaaaggtgaaccaatcatcaacttctacgaccctctcgtcttcccctccgatgagttcgacgcctcaatcagccaagtaaacgaaaagataaaccaatcactcgccttcatccgcaaatccgacgaacttcttcacaacgtcaacgtcggcaaatctaccaccaacataatgataaccaccatcatcatcgtcatcatcgtaatactcctccttctcatcgccgtcggcctattcctatactgcaaagcccgctagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13932 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut0 (opt1)
  source 1..1762: mol_type = other RNA
gggagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13933 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut0 (opt1)
  source 1..1762: mol_type = other RNA
gggagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13934 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut0 (opt2)
  source 1..1762: mol_type = other RNA
gggagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13935 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut0 (opt3)
  source 1..1762: mol_type = other RNA
gggagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13936 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut0 (opt4)
  source 1..1762: mol_type = other RNA
gggagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13937 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut0 (opt5)
  source 1..1762: mol_type = other RNA
gggagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13938 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut0 (opt6)
  source 1..1762: mol_type = other RNA
gggagaaagcttaccatggaactcccaatacttaaaacaaacgcaatcacaacaatactagctgcagtcacactatgcttcgcctcatcacaaaatataacagaagaattttatcaatcaacatgctccgcagtatcaaaaggatatctctctgcattacgaacaggttggtacacctcggtaataacaatagaattatcaaacataaaagaaaataaatgcaatggaaccgatgccaaagtaaaactaatcaaacaagaacttgacaaatacaaaaacgcagtaacagaactacaactattaatgcaatcaacaccagcagcaggttcaggctccgcaatcgcttcaggaatagccgtttgtaaagtactacacttagaaggagaagtaaataaaataaaaaacgccttactatcaacaaacaaagcagtagtctccctttccaacggagtatcagtcttaacttttaaagtactcgacttaaaaaattacatcgacaaacaactactacccattctaaataaacaatcatgctcaatatcaaacatcgaaacagtaatcgaatttcaacaaaaaaataatagattactagaaataacacgagaattttccgtaaatgccggagtaacgaccccagtctcaacatacatgttaacaaactcagaattactatcactcattaacgatatgccaataacaaatgaccaaaaaaaactaatgtcaaacaacgtccaaatagtacgacaacaatcatactctatcatgtgtataataaaagaagaagttttagcatacgtagtacaactaccactttacggagtcatagacaccccatgctggaaactacacacatcacccttatgtacaacaaacaccaaagaagggtctaacatatgtctcactagaacagatcgaggctggtactgcgacaacgcaggatcagttagctttttccctcaagccgaaacctgtaaagtacaatccaatcgagtattttgcgacactatgaactctagaaccttaccctccgaagtaaacctatgtaacatagacatatttaatcccaaatatgattgcaaaatcatgacatccaaaacagatgtatcaagctctgtaataacctcactaggagcaatagtttcatgctatggtaaaacaaaatgcaccgcctcaaacaaaaatagagggataatcaaaaccttctcaaatggatgcgactacgtatcaaataaaggagtagacaccgtctccgtaggaaacacactatactacgtaaacaaacaagaaggaaaatcactatacgtaaaaggagaaccaatcataaacttctacgacccacttgttttcccatcagatgaatttgatgcctccatatcacaagtaaacgaaaaaataaaccaatctctagccttcatcagaaaatccgacgaacttttacacaacgtaaacgtaggtaaatcaacaaccaacatcatgataacaacaataataatagtaataattgtaatacttttactacttatcgccgtaggcctattcttatattgtaaagcaagatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13939 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut0 (opt11)
  source 1..1762: mol_type = other RNA
gggagaaagcttaccatggaactaccaatcctcaaaaccaacgccatcactacaatcctagccgcggtaaccctgtgcttcgcctcctcacaaaacatcacagaagaattttaccaatcaacctgctccgccgtatccaaaggatacctgagcgccctgagaaccggctggtacacctccgtcatcaccatagaactctccaacatcaaagaaaacaaatgcaacggtacggacgccaaagttaaactcatcaaacaagaacttgacaaatacaagaacgccgtcacagaactgcaactcctcatgcaatccacccccgccgccggctccggctccgccatagcctccggcatcgccgtctgcaaagtcttacacctagaaggcgaagtcaacaaaatcaaaaacgcactactttccacaaacaaagccgtcgtctcactctccaacggcgtatccgtcctcaccttcaaagtacttgacctcaaaaactacatcgacaaacaactactccccatcctgaacaaacaatcctgctcaatctccaacatcgaaaccgtaatcgagttccaacagaaaaataatcgcctcctggagatcacccgcgagttctccgtcaatgcaggagtcacaaccccagtatcaacctacatgctcaccaactccgaactcctgtcgctcatcaacgacatgcccatcacaaacgaccaaaagaaactcatgtccaacaacgtacaaatcgtcagacaacaatcctattctataatgtgcatcatcaaagaagaagtcctcgcctacgtcgtacaactccccctctacggcgttatcgacaccccctgctggaaactccacacctcacccctctgcaccaccaacacaaaagaaggctccaacatctgcctcactcggaccgaccgcggctggtactgcgacaatgccggcagcgtctccttcttcccacaagccgaaacctgcaaagtccagtccaaccgcgtattctgcgacactatgaactccagaaccctcccctccgaagtaaacctctgcaacatcgacatcttcaacccaaaatacgactgcaaaatcatgacctcaaaaaccgacgtcagctcgtcagtcataaccagcctcggagccatagtctcatgctacggaaaaaccaaatgcaccgccagcaacaaaaaccgcggcataataaaaacattctccaacggctgcgactatgtatccaacaaaggagtcgataccgtctccgtaggcaacaccctatactacgtcaacaaacaagaaggcaaatccctctacgtcaaaggtgaaccaatcatcaacttctacgaccctctcgtcttcccctccgatgagttcgacgcctcaatcagccaagtaaacgaaaagataaaccaatcactcgccttcatccgcaaatccgacgaacttcttcacaacgtcaacgtcggcaaatctaccaccaacataatgataaccaccatcatcatcgtcatcatcgtaatactcctccttctcatcgccgtcggcctattcctatactgcaaagcccgctagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13940 - protein, 535 aa, synthetic construct
  REGION 1..535: note = derived and/or modified protein sequence (artificial) from HRSV(Memphis-37)__AIY60640.1__F_DSCav1_mut1
MELPILKTNAITTILAAVTLCFASSQNITEEFYQSTCSAVSKGYLGALRTGWYTSVITIELSNIKENKCNGTDAKVKLIKQELDKYKNAVTELQLLMQSTPAAGSGSAICSGIAVCKVLHLEGEVNKIKNALLSTNKAVVSLSNGVSVLTFKVLDLKNYIDKQLLPILNKQSCSIPNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYCVNKQEGQSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 13941 - RNA, 1608 nt, synthetic construct
  misc_feature 1..1608: note = derived and/or modified CDS sequence (opt1) from HRSV(Memphis-37)__AIY60640.1__F_DSCav1_mut1
  source 1..1608: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactga

SEQ ID NO: 13942 - RNA, 1608 nt, synthetic construct
  misc_feature 1..1608: note = derived and/or modified CDS sequence (opt1) from HRSV(Memphis-37)__AIY60640.1__F_DSCav1_mut1
  source 1..1608: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactga

SEQ ID NO: 13943 - RNA, 1608 nt, synthetic construct
  misc_feature 1..1608: note = derived and/or modified CDS sequence (opt2) from HRSV(Memphis-37)__AIY60640.1__F_DSCav1_mut1
  source 1..1608: mol_type = other RNA
atggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactga

SEQ ID NO: 13944 - RNA, 1608 nt, synthetic construct
  misc_feature 1..1608: note = derived and/or modified CDS sequence (opt3) from HRSV(Memphis-37)__AIY60640.1__F_DSCav1_mut1
  source 1..1608: mol_type = other RNA
atggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagaccaactcagtggcattaataacatcgcattctctaattga

SEQ ID NO: 13945 - RNA, 1608 nt, synthetic construct
  misc_feature 1..1608: note = derived and/or modified CDS sequence (opt4) from HRSV(Memphis-37)__AIY60640.1__F_DSCav1_mut1
  source 1..1608: mol_type = other RNA
atggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactga

SEQ ID NO: 13946 - RNA, 1608 nt, synthetic construct
  misc_feature 1..1608: note = derived and/or modified CDS sequence (opt5) from HRSV(Memphis-37)__AIY60640.1__F_DSCav1_mut1
  source 1..1608: mol_type = other RNA
atggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagaccaactctctgggatcaataacattgctttctccaattga

SEQ ID NO: 13947 - RNA, 1608 nt, synthetic construct
  misc_feature 1..1608: note = derived and/or modified CDS sequence (opt6) from HRSV(Memphis-37)__AIY60640.1__F_DSCav1_mut1
  source 1..1608: mol_type = other RNA
atggaacttccaattctaaaaaccaatgctataacaacaatattagcagcagttacattatgcttcgcctcatcacaaaatatcacagaagaattttaccaatccacatgctcagcagtatctaaagggtacctaggagccctacgaacaggatggtacacatcagtaataacaatagaactctcaaacatcaaagaaaacaaatgcaatggaacagacgctaaagtaaaattaataaaacaagaactagacaaatacaaaaacgccgtcaccgaacttcagttactcatgcaaagcacacctgcagcaggatcaggttcagcaatatgctcaggaatagcagtttgcaaagtattacacctagaaggtgaagtcaacaaaataaaaaacgcacttctaagtactaacaaagctgtagtatcattatcaaacggagtatccgtactaacctttaaagtcctagacctaaaaaactacatagacaaacaactactcccaatactcaataaacaatcctgctcaattcccaacatcgaaacagtaatagaatttcaacaaaaaaacaatcgccttctagaaataacaagagaattttcagtcaacgccggagtaacaacaccagtatcaacatatatgctaacaaacagtgaactattatccttaataaacgacatgccaataacaaatgaccaaaaaaaactaatgtccaataatgtccaaatagtaagacaacaaagctattcaattatgtgtataataaaagaagaagtattagcatacgtagttcaactaccactatatggcgttatagacacaccatgctggaaattacacacaagcccactatgcacaacaaatacaaaagaaggatccaacatttgcttaactagaactgacagaggatggtactgcgacaacgctggatcagtctctttcttcccacaagcagaaacctgtaaagtacaatcaaatagagtcttctgcgacacaatgaactcactaactctcccatctgaagtaaacttatgcaacatcgatatatttaacccaaaatacgattgtaaaataatgacatccaaaacagacgtttcatcaagcgtaatcacctccctcggagcaatcgtaagctgctacggtaaaacaaaatgcacagcatccaacaaaaacagaggcatcataaaaacattctcaaacggatgtgactatgtatcaaacaaaggagtagacacagtttcagtaggcaataccttatactgtgtcaataaacaagaaggacaatcactatatgtaaaaggagaacctataataaacttctacgaccccctcgtcttccctagcgatgaatttgacgcatcaatatcgcaagtaaacgaaaaaataaaccaatcattagcctttataagaaaatcagacgaattattacacaacgtaaacgtggggaaaagcacaactaacatcatgataacaactatcataattgtaatcatcgtcatcctattactcctaatcgcagtaggactattcctatactgcaaagctagatcaacaccagtcaccctatcgaaagatcaattgtcaggaataaacaatatagccttttcaaattaa

SEQ ID NO: 13948 - RNA, 1608 nt, synthetic construct
  misc_feature 1..1608: note = derived and/or modified CDS sequence (opt11) from HRSV(Memphis-37)__AIY60640.1__F_DSCav1_mut1
  source 1..1608: mol_type = other RNA
atggaactccccatcctcaaaacgaacgccatcacaaccatcctcgccgccgtcaccctctgcttcgcgtcatcccaaaacataactgaagagttctatcaatcaacctgctccgcagtctcaaaaggctacctcggcgccctacggaccggctggtacacaagcgtcatcacaatagaactttccaacatcaaagaaaacaaatgtaacggcaccgacgcaaaagtcaaactcataaaacaagaactagacaaatataaaaacgccgtaactgaactacaactcctcatgcaatcaactcctgcagccggtagcggctccgcaatctgctcaggcatcgcagtctgcaaagtcttacacctagaaggcgaagtcaacaaaatcaagaacgccctactatccacaaacaaagcagtagtctctctatccaacggagtctccgtcctcacattcaaagtactcgacctaaagaactacatcgacaaacaactactaccaatcttaaacaaacaatcctgctcaatccctaacattgaaaccgtcatagagttccaacagaaaaacaaccgcctcctcgaaataaccagagagttctcagtcaacgccggcgtcaccaccccggtctcaacctacatgctaaccaactctgaacttctcagcctaatcaacgacatgcccattaccaacgaccaaaagaaactcatgtccaataacgtccaaatcgttcgacaacaatcctactcaatcatgtgcatcataaaagaagaagtcctagcatacgtcgtccaactcccactatacggcgtaatcgacaccccctgctggaaactccacacctcccctctctgtaccaccaacaccaaagaagggtccaacatctgcctcacgcgcaccgaccgaggctggtattgcgacaatgcaggctctgtctccttcttcccccaagccgaaacctgcaaagtccaatctaaccgcgtcttctgcgacaccatgaacagtcttaccctcccgtcagaagtcaacctctgcaacatagatatcttcaacccaaaatacgactgcaaaatcatgacctcaaaaaccgacgtttcctcatccgttatcacctccctcggcgcaatcgtcagctgctacggcaagacaaagtgcacggcttcaaacaaaaaccgcggaatcatcaagacattcagcaacggctgcgactacgtatccaacaaaggagtggacacagtctccgttggaaacaccctctactgcgtaaacaaacaagaaggccaatcactctacgtcaaaggcgaacccatcatcaacttctacgacccactcgtcttcccctccgacgagttcgacgcctcaatcagccaagtcaacgagaaaattaaccagtcactcgccttcatacgcaaatccgacgaacttctacacaacgtaaacgtcggaaaatcaaccacaaacatcatgattaccacaattatcatagtcatcatagtaatcctcctgctactcatagcagtcggactcttcctatactgcaaagcccgctccacccctgtcaccctatccaaagaccaactttccggcatcaacaacatagccttttccaactaa

SEQ ID NO: 13949 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut1 (opt1)
  source 1..1884: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13950 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut1 (opt1)
  source 1..1884: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13951 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut1 (opt2)
  source 1..1884: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13952 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut1 (opt3)
  source 1..1884: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagaccaactcagtggcattaataacatcgcattctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13953 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut1 (opt4)
  source 1..1884: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13954 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut1 (opt5)
  source 1..1884: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagaccaactctctgggatcaataacattgctttctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13955 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut1 (opt6)
  source 1..1884: mol_type = other RNA
gggagagtcccgcagtcggcgtccagcggctctgcttgttcgtgtgtgtgtcgttgcaggccttattcaagcttaccatggaacttccaattctaaaaaccaatgctataacaacaatattagcagcagttacattatgcttcgcctcatcacaaaatatcacagaagaattttaccaatccacatgctcagcagtatctaaagggtacctaggagccctacgaacaggatggtacacatcagtaataacaatagaactctcaaacatcaaagaaaacaaatgcaatggaacagacgctaaagtaaaattaataaaacaagaactagacaaatacaaaaacgccgtcaccgaacttcagttactcatgcaaagcacacctgcagcaggatcaggttcagcaatatgctcaggaatagcagtttgcaaagtattacacctagaaggtgaagtcaacaaaataaaaaacgcacttctaagtactaacaaagctgtagtatcattatcaaacggagtatccgtactaacctttaaagtcctagacctaaaaaactacatagacaaacaactactcccaatactcaataaacaatcctgctcaattcccaacatcgaaacagtaatagaatttcaacaaaaaaacaatcgccttctagaaataacaagagaattttcagtcaacgccggagtaacaacaccagtatcaacatatatgctaacaaacagtgaactattatccttaataaacgacatgccaataacaaatgaccaaaaaaaactaatgtccaataatgtccaaatagtaagacaacaaagctattcaattatgtgtataataaaagaagaagtattagcatacgtagttcaactaccactatatggcgttatagacacaccatgctggaaattacacacaagcccactatgcacaacaaatacaaaagaaggatccaacatttgcttaactagaactgacagaggatggtactgcgacaacgctggatcagtctctttcttcccacaagcagaaacctgtaaagtacaatcaaatagagtcttctgcgacacaatgaactcactaactctcccatctgaagtaaacttatgcaacatcgatatatttaacccaaaatacgattgtaaaataatgacatccaaaacagacgtttcatcaagcgtaatcacctccctcggagcaatcgtaagctgctacggtaaaacaaaatgcacagcatccaacaaaaacagaggcatcataaaaacattctcaaacggatgtgactatgtatcaaacaaaggagtagacacagtttcagtaggcaataccttatactgtgtcaataaacaagaaggacaatcactatatgtaaaaggagaacctataataaacttctacgaccccctcgtcttccctagcgatgaatttgacgcatcaatatcgcaagtaaacgaaaaaataaaccaatcattagcctttataagaaaatcagacgaattattacacaacgtaaacgtggggaaaagcacaactaacatcatgataacaactatcataattgtaatcatcgtcatcctattactcctaatcgcagtaggactattcctatactgcaaagctagatcaacaccagtcaccctatcgaaagatcaattgtcaggaataaacaatatagccttttcaaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13956 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut1 (opt11)
  source 1..1884: mol_type = other RNA
gggagagtcccgcagtcggcgtccagcggctctgcttgttcgtgtgtgtgtcgttgcaggccttattcaagcttaccatggaactccccatcctcaaaacgaacgccatcacaaccatcctcgccgccgtcaccctctgcttcgcgtcatcccaaaacataactgaagagttctatcaatcaacctgctccgcagtctcaaaaggctacctcggcgccctacggaccggctggtacacaagcgtcatcacaatagaactttccaacatcaaagaaaacaaatgtaacggcaccgacgcaaaagtcaaactcataaaacaagaactagacaaatataaaaacgccgtaactgaactacaactcctcatgcaatcaactcctgcagccggtagcggctccgcaatctgctcaggcatcgcagtctgcaaagtcttacacctagaaggcgaagtcaacaaaatcaagaacgccctactatccacaaacaaagcagtagtctctctatccaacggagtctccgtcctcacattcaaagtactcgacctaaagaactacatcgacaaacaactactaccaatcttaaacaaacaatcctgctcaatccctaacattgaaaccgtcatagagttccaacagaaaaacaaccgcctcctcgaaataaccagagagttctcagtcaacgccggcgtcaccaccccggtctcaacctacatgctaaccaactctgaacttctcagcctaatcaacgacatgcccattaccaacgaccaaaagaaactcatgtccaataacgtccaaatcgttcgacaacaatcctactcaatcatgtgcatcataaaagaagaagtcctagcatacgtcgtccaactcccactatacggcgtaatcgacaccccctgctggaaactccacacctcccctctctgtaccaccaacaccaaagaagggtccaacatctgcctcacgcgcaccgaccgaggctggtattgcgacaatgcaggctctgtctccttcttcccccaagccgaaacctgcaaagtccaatctaaccgcgtcttctgcgacaccatgaacagtcttaccctcccgtcagaagtcaacctctgcaacatagatatcttcaacccaaaatacgactgcaaaatcatgacctcaaaaaccgacgtttcctcatccgttatcacctccctcggcgcaatcgtcagctgctacggcaagacaaagtgcacggcttcaaacaaaaaccgcggaatcatcaagacattcagcaacggctgcgactacgtatccaacaaaggagtggacacagtctccgttggaaacaccctctactgcgtaaacaaacaagaaggccaatcactctacgtcaaaggcgaacccatcatcaacttctacgacccactcgtcttcccctccgacgagttcgacgcctcaatcagccaagtcaacgagaaaattaaccagtcactcgccttcatacgcaaatccgacgaacttctacacaacgtaaacgtcggaaaatcaaccacaaacatcatgattaccacaattatcatagtcatcatagtaatcctcctgctactcatagcagtcggactcttcctatactgcaaagcccgctccacccctgtcaccctatccaaagaccaactttccggcatcaacaacatagccttttccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13957 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut1 (opt1)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13958 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut1 (opt1)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13959 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut1 (opt2)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13960 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut1 (opt3)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagaccaactcagtggcattaataacatcgcattctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13961 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut1 (opt4)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13962 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut1 (opt5)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagaccaactctctgggatcaataacattgctttctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13963 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut1 (opt6)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggaacttccaattctaaaaaccaatgctataacaacaatattagcagcagttacattatgcttcgcctcatcacaaaatatcacagaagaattttaccaatccacatgctcagcagtatctaaagggtacctaggagccctacgaacaggatggtacacatcagtaataacaatagaactctcaaacatcaaagaaaacaaatgcaatggaacagacgctaaagtaaaattaataaaacaagaactagacaaatacaaaaacgccgtcaccgaacttcagttactcatgcaaagcacacctgcagcaggatcaggttcagcaatatgctcaggaatagcagtttgcaaagtattacacctagaaggtgaagtcaacaaaataaaaaacgcacttctaagtactaacaaagctgtagtatcattatcaaacggagtatccgtactaacctttaaagtcctagacctaaaaaactacatagacaaacaactactcccaatactcaataaacaatcctgctcaattcccaacatcgaaacagtaatagaatttcaacaaaaaaacaatcgccttctagaaataacaagagaattttcagtcaacgccggagtaacaacaccagtatcaacatatatgctaacaaacagtgaactattatccttaataaacgacatgccaataacaaatgaccaaaaaaaactaatgtccaataatgtccaaatagtaagacaacaaagctattcaattatgtgtataataaaagaagaagtattagcatacgtagttcaactaccactatatggcgttatagacacaccatgctggaaattacacacaagcccactatgcacaacaaatacaaaagaaggatccaacatttgcttaactagaactgacagaggatggtactgcgacaacgctggatcagtctctttcttcccacaagcagaaacctgtaaagtacaatcaaatagagtcttctgcgacacaatgaactcactaactctcccatctgaagtaaacttatgcaacatcgatatatttaacccaaaatacgattgtaaaataatgacatccaaaacagacgtttcatcaagcgtaatcacctccctcggagcaatcgtaagctgctacggtaaaacaaaatgcacagcatccaacaaaaacagaggcatcataaaaacattctcaaacggatgtgactatgtatcaaacaaaggagtagacacagtttcagtaggcaataccttatactgtgtcaataaacaagaaggacaatcactatatgtaaaaggagaacctataataaacttctacgaccccctcgtcttccctagcgatgaatttgacgcatcaatatcgcaagtaaacgaaaaaataaaccaatcattagcctttataagaaaatcagacgaattattacacaacgtaaacgtggggaaaagcacaactaacatcatgataacaactatcataattgtaatcatcgtcatcctattactcctaatcgcagtaggactattcctatactgcaaagctagatcaacaccagtcaccctatcgaaagatcaattgtcaggaataaacaatatagccttttcaaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13964 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut1 (opt11)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggaactccccatcctcaaaacgaacgccatcacaaccatcctcgccgccgtcaccctctgcttcgcgtcatcccaaaacataactgaagagttctatcaatcaacctgctccgcagtctcaaaaggctacctcggcgccctacggaccggctggtacacaagcgtcatcacaatagaactttccaacatcaaagaaaacaaatgtaacggcaccgacgcaaaagtcaaactcataaaacaagaactagacaaatataaaaacgccgtaactgaactacaactcctcatgcaatcaactcctgcagccggtagcggctccgcaatctgctcaggcatcgcagtctgcaaagtcttacacctagaaggcgaagtcaacaaaatcaagaacgccctactatccacaaacaaagcagtagtctctctatccaacggagtctccgtcctcacattcaaagtactcgacctaaagaactacatcgacaaacaactactaccaatcttaaacaaacaatcctgctcaatccctaacattgaaaccgtcatagagttccaacagaaaaacaaccgcctcctcgaaataaccagagagttctcagtcaacgccggcgtcaccaccccggtctcaacctacatgctaaccaactctgaacttctcagcctaatcaacgacatgcccattaccaacgaccaaaagaaactcatgtccaataacgtccaaatcgttcgacaacaatcctactcaatcatgtgcatcataaaagaagaagtcctagcatacgtcgtccaactcccactatacggcgtaatcgacaccccctgctggaaactccacacctcccctctctgtaccaccaacaccaaagaagggtccaacatctgcctcacgcgcaccgaccgaggctggtattgcgacaatgcaggctctgtctccttcttcccccaagccgaaacctgcaaagtccaatctaaccgcgtcttctgcgacaccatgaacagtcttaccctcccgtcagaagtcaacctctgcaacatagatatcttcaacccaaaatacgactgcaaaatcatgacctcaaaaaccgacgtttcctcatccgttatcacctccctcggcgcaatcgtcagctgctacggcaagacaaagtgcacggcttcaaacaaaaaccgcggaatcatcaagacattcagcaacggctgcgactacgtatccaacaaaggagtggacacagtctccgttggaaacaccctctactgcgtaaacaaacaagaaggccaatcactctacgtcaaaggcgaacccatcatcaacttctacgacccactcgtcttcccctccgacgagttcgacgcctcaatcagccaagtcaacgagaaaattaaccagtcactcgccttcatacgcaaatccgacgaacttctacacaacgtaaacgtcggaaaatcaaccacaaacatcatgattaccacaattatcatagtcatcatagtaatcctcctgctactcatagcagtcggactcttcctatactgcaaagcccgctccacccctgtcaccctatccaaagaccaactttccggcatcaacaacatagccttttccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13965 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut1 (opt1)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13966 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut1 (opt1)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13967 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut1 (opt2)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13968 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut1 (opt3)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagaccaactcagtggcattaataacatcgcattctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13969 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut1 (opt4)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13970 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut1 (opt5)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagaccaactctctgggatcaataacattgctttctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13971 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut1 (opt6)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttccaattctaaaaaccaatgctataacaacaatattagcagcagttacattatgcttcgcctcatcacaaaatatcacagaagaattttaccaatccacatgctcagcagtatctaaagggtacctaggagccctacgaacaggatggtacacatcagtaataacaatagaactctcaaacatcaaagaaaacaaatgcaatggaacagacgctaaagtaaaattaataaaacaagaactagacaaatacaaaaacgccgtcaccgaacttcagttactcatgcaaagcacacctgcagcaggatcaggttcagcaatatgctcaggaatagcagtttgcaaagtattacacctagaaggtgaagtcaacaaaataaaaaacgcacttctaagtactaacaaagctgtagtatcattatcaaacggagtatccgtactaacctttaaagtcctagacctaaaaaactacatagacaaacaactactcccaatactcaataaacaatcctgctcaattcccaacatcgaaacagtaatagaatttcaacaaaaaaacaatcgccttctagaaataacaagagaattttcagtcaacgccggagtaacaacaccagtatcaacatatatgctaacaaacagtgaactattatccttaataaacgacatgccaataacaaatgaccaaaaaaaactaatgtccaataatgtccaaatagtaagacaacaaagctattcaattatgtgtataataaaagaagaagtattagcatacgtagttcaactaccactatatggcgttatagacacaccatgctggaaattacacacaagcccactatgcacaacaaatacaaaagaaggatccaacatttgcttaactagaactgacagaggatggtactgcgacaacgctggatcagtctctttcttcccacaagcagaaacctgtaaagtacaatcaaatagagtcttctgcgacacaatgaactcactaactctcccatctgaagtaaacttatgcaacatcgatatatttaacccaaaatacgattgtaaaataatgacatccaaaacagacgtttcatcaagcgtaatcacctccctcggagcaatcgtaagctgctacggtaaaacaaaatgcacagcatccaacaaaaacagaggcatcataaaaacattctcaaacggatgtgactatgtatcaaacaaaggagtagacacagtttcagtaggcaataccttatactgtgtcaataaacaagaaggacaatcactatatgtaaaaggagaacctataataaacttctacgaccccctcgtcttccctagcgatgaatttgacgcatcaatatcgcaagtaaacgaaaaaataaaccaatcattagcctttataagaaaatcagacgaattattacacaacgtaaacgtggggaaaagcacaactaacatcatgataacaactatcataattgtaatcatcgtcatcctattactcctaatcgcagtaggactattcctatactgcaaagctagatcaacaccagtcaccctatcgaaagatcaattgtcaggaataaacaatatagccttttcaaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13972 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut1 (opt11)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatcctcaaaacgaacgccatcacaaccatcctcgccgccgtcaccctctgcttcgcgtcatcccaaaacataactgaagagttctatcaatcaacctgctccgcagtctcaaaaggctacctcggcgccctacggaccggctggtacacaagcgtcatcacaatagaactttccaacatcaaagaaaacaaatgtaacggcaccgacgcaaaagtcaaactcataaaacaagaactagacaaatataaaaacgccgtaactgaactacaactcctcatgcaatcaactcctgcagccggtagcggctccgcaatctgctcaggcatcgcagtctgcaaagtcttacacctagaaggcgaagtcaacaaaatcaagaacgccctactatccacaaacaaagcagtagtctctctatccaacggagtctccgtcctcacattcaaagtactcgacctaaagaactacatcgacaaacaactactaccaatcttaaacaaacaatcctgctcaatccctaacattgaaaccgtcatagagttccaacagaaaaacaaccgcctcctcgaaataaccagagagttctcagtcaacgccggcgtcaccaccccggtctcaacctacatgctaaccaactctgaacttctcagcctaatcaacgacatgcccattaccaacgaccaaaagaaactcatgtccaataacgtccaaatcgttcgacaacaatcctactcaatcatgtgcatcataaaagaagaagtcctagcatacgtcgtccaactcccactatacggcgtaatcgacaccccctgctggaaactccacacctcccctctctgtaccaccaacaccaaagaagggtccaacatctgcctcacgcgcaccgaccgaggctggtattgcgacaatgcaggctctgtctccttcttcccccaagccgaaacctgcaaagtccaatctaaccgcgtcttctgcgacaccatgaacagtcttaccctcccgtcagaagtcaacctctgcaacatagatatcttcaacccaaaatacgactgcaaaatcatgacctcaaaaaccgacgtttcctcatccgttatcacctccctcggcgcaatcgtcagctgctacggcaagacaaagtgcacggcttcaaacaaaaaccgcggaatcatcaagacattcagcaacggctgcgactacgtatccaacaaaggagtggacacagtctccgttggaaacaccctctactgcgtaaacaaacaagaaggccaatcactctacgtcaaaggcgaacccatcatcaacttctacgacccactcgtcttcccctccgacgagttcgacgcctcaatcagccaagtcaacgagaaaattaaccagtcactcgccttcatacgcaaatccgacgaacttctacacaacgtaaacgtcggaaaatcaaccacaaacatcatgattaccacaattatcatagtcatcatagtaatcctcctgctactcatagcagtcggactcttcctatactgcaaagcccgctccacccctgtcaccctatccaaagaccaactttccggcatcaacaacatagccttttccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13973 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut1 (opt1)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13974 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut1 (opt1)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13975 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut1 (opt2)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13976 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut1 (opt3)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagaccaactcagtggcattaataacatcgcattctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13977 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut1 (opt4)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13978 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut1 (opt5)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagaccaactctctgggatcaataacattgctttctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13979 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut1 (opt6)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttccaattctaaaaaccaatgctataacaacaatattagcagcagttacattatgcttcgcctcatcacaaaatatcacagaagaattttaccaatccacatgctcagcagtatctaaagggtacctaggagccctacgaacaggatggtacacatcagtaataacaatagaactctcaaacatcaaagaaaacaaatgcaatggaacagacgctaaagtaaaattaataaaacaagaactagacaaatacaaaaacgccgtcaccgaacttcagttactcatgcaaagcacacctgcagcaggatcaggttcagcaatatgctcaggaatagcagtttgcaaagtattacacctagaaggtgaagtcaacaaaataaaaaacgcacttctaagtactaacaaagctgtagtatcattatcaaacggagtatccgtactaacctttaaagtcctagacctaaaaaactacatagacaaacaactactcccaatactcaataaacaatcctgctcaattcccaacatcgaaacagtaatagaatttcaacaaaaaaacaatcgccttctagaaataacaagagaattttcagtcaacgccggagtaacaacaccagtatcaacatatatgctaacaaacagtgaactattatccttaataaacgacatgccaataacaaatgaccaaaaaaaactaatgtccaataatgtccaaatagtaagacaacaaagctattcaattatgtgtataataaaagaagaagtattagcatacgtagttcaactaccactatatggcgttatagacacaccatgctggaaattacacacaagcccactatgcacaacaaatacaaaagaaggatccaacatttgcttaactagaactgacagaggatggtactgcgacaacgctggatcagtctctttcttcccacaagcagaaacctgtaaagtacaatcaaatagagtcttctgcgacacaatgaactcactaactctcccatctgaagtaaacttatgcaacatcgatatatttaacccaaaatacgattgtaaaataatgacatccaaaacagacgtttcatcaagcgtaatcacctccctcggagcaatcgtaagctgctacggtaaaacaaaatgcacagcatccaacaaaaacagaggcatcataaaaacattctcaaacggatgtgactatgtatcaaacaaaggagtagacacagtttcagtaggcaataccttatactgtgtcaataaacaagaaggacaatcactatatgtaaaaggagaacctataataaacttctacgaccccctcgtcttccctagcgatgaatttgacgcatcaatatcgcaagtaaacgaaaaaataaaccaatcattagcctttataagaaaatcagacgaattattacacaacgtaaacgtggggaaaagcacaactaacatcatgataacaactatcataattgtaatcatcgtcatcctattactcctaatcgcagtaggactattcctatactgcaaagctagatcaacaccagtcaccctatcgaaagatcaattgtcaggaataaacaatatagccttttcaaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13980 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut1 (opt11)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactccccatcctcaaaacgaacgccatcacaaccatcctcgccgccgtcaccctctgcttcgcgtcatcccaaaacataactgaagagttctatcaatcaacctgctccgcagtctcaaaaggctacctcggcgccctacggaccggctggtacacaagcgtcatcacaatagaactttccaacatcaaagaaaacaaatgtaacggcaccgacgcaaaagtcaaactcataaaacaagaactagacaaatataaaaacgccgtaactgaactacaactcctcatgcaatcaactcctgcagccggtagcggctccgcaatctgctcaggcatcgcagtctgcaaagtcttacacctagaaggcgaagtcaacaaaatcaagaacgccctactatccacaaacaaagcagtagtctctctatccaacggagtctccgtcctcacattcaaagtactcgacctaaagaactacatcgacaaacaactactaccaatcttaaacaaacaatcctgctcaatccctaacattgaaaccgtcatagagttccaacagaaaaacaaccgcctcctcgaaataaccagagagttctcagtcaacgccggcgtcaccaccccggtctcaacctacatgctaaccaactctgaacttctcagcctaatcaacgacatgcccattaccaacgaccaaaagaaactcatgtccaataacgtccaaatcgttcgacaacaatcctactcaatcatgtgcatcataaaagaagaagtcctagcatacgtcgtccaactcccactatacggcgtaatcgacaccccctgctggaaactccacacctcccctctctgtaccaccaacaccaaagaagggtccaacatctgcctcacgcgcaccgaccgaggctggtattgcgacaatgcaggctctgtctccttcttcccccaagccgaaacctgcaaagtccaatctaaccgcgtcttctgcgacaccatgaacagtcttaccctcccgtcagaagtcaacctctgcaacatagatatcttcaacccaaaatacgactgcaaaatcatgacctcaaaaaccgacgtttcctcatccgttatcacctccctcggcgcaatcgtcagctgctacggcaagacaaagtgcacggcttcaaacaaaaaccgcggaatcatcaagacattcagcaacggctgcgactacgtatccaacaaaggagtggacacagtctccgttggaaacaccctctactgcgtaaacaaacaagaaggccaatcactctacgtcaaaggcgaacccatcatcaacttctacgacccactcgtcttcccctccgacgagttcgacgcctcaatcagccaagtcaacgagaaaattaaccagtcactcgccttcatacgcaaatccgacgaacttctacacaacgtaaacgtcggaaaatcaaccacaaacatcatgattaccacaattatcatagtcatcatagtaatcctcctgctactcatagcagtcggactcttcctatactgcaaagcccgctccacccctgtcaccctatccaaagaccaactttccggcatcaacaacatagccttttccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13981 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut1 (opt1)
  source 1..1876: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13982 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut1 (opt1)
  source 1..1876: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13983 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut1 (opt2)
  source 1..1876: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13984 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut1 (opt3)
  source 1..1876: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagaccaactcagtggcattaataacatcgcattctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13985 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut1 (opt4)
  source 1..1876: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13986 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut1 (opt5)
  source 1..1876: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagaccaactctctgggatcaataacattgctttctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13987 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut1 (opt6)
  source 1..1876: mol_type = other RNA
gggagactttcccattctgtagcagaatttggtgttgcctgtggtcttggtcccgcggagaagcttaccatggaacttccaattctaaaaaccaatgctataacaacaatattagcagcagttacattatgcttcgcctcatcacaaaatatcacagaagaattttaccaatccacatgctcagcagtatctaaagggtacctaggagccctacgaacaggatggtacacatcagtaataacaatagaactctcaaacatcaaagaaaacaaatgcaatggaacagacgctaaagtaaaattaataaaacaagaactagacaaatacaaaaacgccgtcaccgaacttcagttactcatgcaaagcacacctgcagcaggatcaggttcagcaatatgctcaggaatagcagtttgcaaagtattacacctagaaggtgaagtcaacaaaataaaaaacgcacttctaagtactaacaaagctgtagtatcattatcaaacggagtatccgtactaacctttaaagtcctagacctaaaaaactacatagacaaacaactactcccaatactcaataaacaatcctgctcaattcccaacatcgaaacagtaatagaatttcaacaaaaaaacaatcgccttctagaaataacaagagaattttcagtcaacgccggagtaacaacaccagtatcaacatatatgctaacaaacagtgaactattatccttaataaacgacatgccaataacaaatgaccaaaaaaaactaatgtccaataatgtccaaatagtaagacaacaaagctattcaattatgtgtataataaaagaagaagtattagcatacgtagttcaactaccactatatggcgttatagacacaccatgctggaaattacacacaagcccactatgcacaacaaatacaaaagaaggatccaacatttgcttaactagaactgacagaggatggtactgcgacaacgctggatcagtctctttcttcccacaagcagaaacctgtaaagtacaatcaaatagagtcttctgcgacacaatgaactcactaactctcccatctgaagtaaacttatgcaacatcgatatatttaacccaaaatacgattgtaaaataatgacatccaaaacagacgtttcatcaagcgtaatcacctccctcggagcaatcgtaagctgctacggtaaaacaaaatgcacagcatccaacaaaaacagaggcatcataaaaacattctcaaacggatgtgactatgtatcaaacaaaggagtagacacagtttcagtaggcaataccttatactgtgtcaataaacaagaaggacaatcactatatgtaaaaggagaacctataataaacttctacgaccccctcgtcttccctagcgatgaatttgacgcatcaatatcgcaagtaaacgaaaaaataaaccaatcattagcctttataagaaaatcagacgaattattacacaacgtaaacgtggggaaaagcacaactaacatcatgataacaactatcataattgtaatcatcgtcatcctattactcctaatcgcagtaggactattcctatactgcaaagctagatcaacaccagtcaccctatcgaaagatcaattgtcaggaataaacaatatagccttttcaaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13988 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut1 (opt11)
  source 1..1876: mol_type = other RNA
gggagactttcccattctgtagcagaatttggtgttgcctgtggtcttggtcccgcggagaagcttaccatggaactccccatcctcaaaacgaacgccatcacaaccatcctcgccgccgtcaccctctgcttcgcgtcatcccaaaacataactgaagagttctatcaatcaacctgctccgcagtctcaaaaggctacctcggcgccctacggaccggctggtacacaagcgtcatcacaatagaactttccaacatcaaagaaaacaaatgtaacggcaccgacgcaaaagtcaaactcataaaacaagaactagacaaatataaaaacgccgtaactgaactacaactcctcatgcaatcaactcctgcagccggtagcggctccgcaatctgctcaggcatcgcagtctgcaaagtcttacacctagaaggcgaagtcaacaaaatcaagaacgccctactatccacaaacaaagcagtagtctctctatccaacggagtctccgtcctcacattcaaagtactcgacctaaagaactacatcgacaaacaactactaccaatcttaaacaaacaatcctgctcaatccctaacattgaaaccgtcatagagttccaacagaaaaacaaccgcctcctcgaaataaccagagagttctcagtcaacgccggcgtcaccaccccggtctcaacctacatgctaaccaactctgaacttctcagcctaatcaacgacatgcccattaccaacgaccaaaagaaactcatgtccaataacgtccaaatcgttcgacaacaatcctactcaatcatgtgcatcataaaagaagaagtcctagcatacgtcgtccaactcccactatacggcgtaatcgacaccccctgctggaaactccacacctcccctctctgtaccaccaacaccaaagaagggtccaacatctgcctcacgcgcaccgaccgaggctggtattgcgacaatgcaggctctgtctccttcttcccccaagccgaaacctgcaaagtccaatctaaccgcgtcttctgcgacaccatgaacagtcttaccctcccgtcagaagtcaacctctgcaacatagatatcttcaacccaaaatacgactgcaaaatcatgacctcaaaaaccgacgtttcctcatccgttatcacctccctcggcgcaatcgtcagctgctacggcaagacaaagtgcacggcttcaaacaaaaaccgcggaatcatcaagacattcagcaacggctgcgactacgtatccaacaaaggagtggacacagtctccgttggaaacaccctctactgcgtaaacaaacaagaaggccaatcactctacgtcaaaggcgaacccatcatcaacttctacgacccactcgtcttcccctccgacgagttcgacgcctcaatcagccaagtcaacgagaaaattaaccagtcactcgccttcatacgcaaatccgacgaacttctacacaacgtaaacgtcggaaaatcaaccacaaacatcatgattaccacaattatcatagtcatcatagtaatcctcctgctactcatagcagtcggactcttcctatactgcaaagcccgctccacccctgtcaccctatccaaagaccaactttccggcatcaacaacatagccttttccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13989 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut1 (opt1)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13990 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut1 (opt1)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13991 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut1 (opt2)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13992 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut1 (opt3)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagaccaactcagtggcattaataacatcgcattctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13993 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut1 (opt4)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13994 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut1 (opt5)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagaccaactctctgggatcaataacattgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13995 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut1 (opt6)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaacttccaattctaaaaaccaatgctataacaacaatattagcagcagttacattatgcttcgcctcatcacaaaatatcacagaagaattttaccaatccacatgctcagcagtatctaaagggtacctaggagccctacgaacaggatggtacacatcagtaataacaatagaactctcaaacatcaaagaaaacaaatgcaatggaacagacgctaaagtaaaattaataaaacaagaactagacaaatacaaaaacgccgtcaccgaacttcagttactcatgcaaagcacacctgcagcaggatcaggttcagcaatatgctcaggaatagcagtttgcaaagtattacacctagaaggtgaagtcaacaaaataaaaaacgcacttctaagtactaacaaagctgtagtatcattatcaaacggagtatccgtactaacctttaaagtcctagacctaaaaaactacatagacaaacaactactcccaatactcaataaacaatcctgctcaattcccaacatcgaaacagtaatagaatttcaacaaaaaaacaatcgccttctagaaataacaagagaattttcagtcaacgccggagtaacaacaccagtatcaacatatatgctaacaaacagtgaactattatccttaataaacgacatgccaataacaaatgaccaaaaaaaactaatgtccaataatgtccaaatagtaagacaacaaagctattcaattatgtgtataataaaagaagaagtattagcatacgtagttcaactaccactatatggcgttatagacacaccatgctggaaattacacacaagcccactatgcacaacaaatacaaaagaaggatccaacatttgcttaactagaactgacagaggatggtactgcgacaacgctggatcagtctctttcttcccacaagcagaaacctgtaaagtacaatcaaatagagtcttctgcgacacaatgaactcactaactctcccatctgaagtaaacttatgcaacatcgatatatttaacccaaaatacgattgtaaaataatgacatccaaaacagacgtttcatcaagcgtaatcacctccctcggagcaatcgtaagctgctacggtaaaacaaaatgcacagcatccaacaaaaacagaggcatcataaaaacattctcaaacggatgtgactatgtatcaaacaaaggagtagacacagtttcagtaggcaataccttatactgtgtcaataaacaagaaggacaatcactatatgtaaaaggagaacctataataaacttctacgaccccctcgtcttccctagcgatgaatttgacgcatcaatatcgcaagtaaacgaaaaaataaaccaatcattagcctttataagaaaatcagacgaattattacacaacgtaaacgtggggaaaagcacaactaacatcatgataacaactatcataattgtaatcatcgtcatcctattactcctaatcgcagtaggactattcctatactgcaaagctagatcaacaccagtcaccctatcgaaagatcaattgtcaggaataaacaatatagccttttcaaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13996 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut1 (opt11)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactccccatcctcaaaacgaacgccatcacaaccatcctcgccgccgtcaccctctgcttcgcgtcatcccaaaacataactgaagagttctatcaatcaacctgctccgcagtctcaaaaggctacctcggcgccctacggaccggctggtacacaagcgtcatcacaatagaactttccaacatcaaagaaaacaaatgtaacggcaccgacgcaaaagtcaaactcataaaacaagaactagacaaatataaaaacgccgtaactgaactacaactcctcatgcaatcaactcctgcagccggtagcggctccgcaatctgctcaggcatcgcagtctgcaaagtcttacacctagaaggcgaagtcaacaaaatcaagaacgccctactatccacaaacaaagcagtagtctctctatccaacggagtctccgtcctcacattcaaagtactcgacctaaagaactacatcgacaaacaactactaccaatcttaaacaaacaatcctgctcaatccctaacattgaaaccgtcatagagttccaacagaaaaacaaccgcctcctcgaaataaccagagagttctcagtcaacgccggcgtcaccaccccggtctcaacctacatgctaaccaactctgaacttctcagcctaatcaacgacatgcccattaccaacgaccaaaagaaactcatgtccaataacgtccaaatcgttcgacaacaatcctactcaatcatgtgcatcataaaagaagaagtcctagcatacgtcgtccaactcccactatacggcgtaatcgacaccccctgctggaaactccacacctcccctctctgtaccaccaacaccaaagaagggtccaacatctgcctcacgcgcaccgaccgaggctggtattgcgacaatgcaggctctgtctccttcttcccccaagccgaaacctgcaaagtccaatctaaccgcgtcttctgcgacaccatgaacagtcttaccctcccgtcagaagtcaacctctgcaacatagatatcttcaacccaaaatacgactgcaaaatcatgacctcaaaaaccgacgtttcctcatccgttatcacctccctcggcgcaatcgtcagctgctacggcaagacaaagtgcacggcttcaaacaaaaaccgcggaatcatcaagacattcagcaacggctgcgactacgtatccaacaaaggagtggacacagtctccgttggaaacaccctctactgcgtaaacaaacaagaaggccaatcactctacgtcaaaggcgaacccatcatcaacttctacgacccactcgtcttcccctccgacgagttcgacgcctcaatcagccaagtcaacgagaaaattaaccagtcactcgccttcatacgcaaatccgacgaacttctacacaacgtaaacgtcggaaaatcaaccacaaacatcatgattaccacaattatcatagtcatcatagtaatcctcctgctactcatagcagtcggactcttcctatactgcaaagcccgctccacccctgtcaccctatccaaagaccaactttccggcatcaacaacatagccttttccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13997 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut1 (opt1)
  source 1..1877: mol_type = other RNA
gggagagcctctgctggagtccggggagtggcgttggctgctagagcgaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13998 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut1 (opt1)
  source 1..1877: mol_type = other RNA
gggagagcctctgctggagtccggggagtggcgttggctgctagagcgaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13999 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut1 (opt2)
  source 1..1877: mol_type = other RNA
gggagagcctctgctggagtccggggagtggcgttggctgctagagcgaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14000 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut1 (opt3)
  source 1..1877: mol_type = other RNA
gggagagcctctgctggagtccggggagtggcgttggctgctagagcgaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagaccaactcagtggcattaataacatcgcattctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14001 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut1 (opt4)
  source 1..1877: mol_type = other RNA
gggagagcctctgctggagtccggggagtggcgttggctgctagagcgaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14002 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut1 (opt5)
  source 1..1877: mol_type = other RNA
gggagagcctctgctggagtccggggagtggcgttggctgctagagcgaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagaccaactctctgggatcaataacattgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14003 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut1 (opt6)
  source 1..1877: mol_type = other RNA
gggagagcctctgctggagtccggggagtggcgttggctgctagagcgaagcttaccatggaacttccaattctaaaaaccaatgctataacaacaatattagcagcagttacattatgcttcgcctcatcacaaaatatcacagaagaattttaccaatccacatgctcagcagtatctaaagggtacctaggagccctacgaacaggatggtacacatcagtaataacaatagaactctcaaacatcaaagaaaacaaatgcaatggaacagacgctaaagtaaaattaataaaacaagaactagacaaatacaaaaacgccgtcaccgaacttcagttactcatgcaaagcacacctgcagcaggatcaggttcagcaatatgctcaggaatagcagtttgcaaagtattacacctagaaggtgaagtcaacaaaataaaaaacgcacttctaagtactaacaaagctgtagtatcattatcaaacggagtatccgtactaacctttaaagtcctagacctaaaaaactacatagacaaacaactactcccaatactcaataaacaatcctgctcaattcccaacatcgaaacagtaatagaatttcaacaaaaaaacaatcgccttctagaaataacaagagaattttcagtcaacgccggagtaacaacaccagtatcaacatatatgctaacaaacagtgaactattatccttaataaacgacatgccaataacaaatgaccaaaaaaaactaatgtccaataatgtccaaatagtaagacaacaaagctattcaattatgtgtataataaaagaagaagtattagcatacgtagttcaactaccactatatggcgttatagacacaccatgctggaaattacacacaagcccactatgcacaacaaatacaaaagaaggatccaacatttgcttaactagaactgacagaggatggtactgcgacaacgctggatcagtctctttcttcccacaagcagaaacctgtaaagtacaatcaaatagagtcttctgcgacacaatgaactcactaactctcccatctgaagtaaacttatgcaacatcgatatatttaacccaaaatacgattgtaaaataatgacatccaaaacagacgtttcatcaagcgtaatcacctccctcggagcaatcgtaagctgctacggtaaaacaaaatgcacagcatccaacaaaaacagaggcatcataaaaacattctcaaacggatgtgactatgtatcaaacaaaggagtagacacagtttcagtaggcaataccttatactgtgtcaataaacaagaaggacaatcactatatgtaaaaggagaacctataataaacttctacgaccccctcgtcttccctagcgatgaatttgacgcatcaatatcgcaagtaaacgaaaaaataaaccaatcattagcctttataagaaaatcagacgaattattacacaacgtaaacgtggggaaaagcacaactaacatcatgataacaactatcataattgtaatcatcgtcatcctattactcctaatcgcagtaggactattcctatactgcaaagctagatcaacaccagtcaccctatcgaaagatcaattgtcaggaataaacaatatagccttttcaaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14004 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut1 (opt11)
  source 1..1877: mol_type = other RNA
gggagagcctctgctggagtccggggagtggcgttggctgctagagcgaagcttaccatggaactccccatcctcaaaacgaacgccatcacaaccatcctcgccgccgtcaccctctgcttcgcgtcatcccaaaacataactgaagagttctatcaatcaacctgctccgcagtctcaaaaggctacctcggcgccctacggaccggctggtacacaagcgtcatcacaatagaactttccaacatcaaagaaaacaaatgtaacggcaccgacgcaaaagtcaaactcataaaacaagaactagacaaatataaaaacgccgtaactgaactacaactcctcatgcaatcaactcctgcagccggtagcggctccgcaatctgctcaggcatcgcagtctgcaaagtcttacacctagaaggcgaagtcaacaaaatcaagaacgccctactatccacaaacaaagcagtagtctctctatccaacggagtctccgtcctcacattcaaagtactcgacctaaagaactacatcgacaaacaactactaccaatcttaaacaaacaatcctgctcaatccctaacattgaaaccgtcatagagttccaacagaaaaacaaccgcctcctcgaaataaccagagagttctcagtcaacgccggcgtcaccaccccggtctcaacctacatgctaaccaactctgaacttctcagcctaatcaacgacatgcccattaccaacgaccaaaagaaactcatgtccaataacgtccaaatcgttcgacaacaatcctactcaatcatgtgcatcataaaagaagaagtcctagcatacgtcgtccaactcccactatacggcgtaatcgacaccccctgctggaaactccacacctcccctctctgtaccaccaacaccaaagaagggtccaacatctgcctcacgcgcaccgaccgaggctggtattgcgacaatgcaggctctgtctccttcttcccccaagccgaaacctgcaaagtccaatctaaccgcgtcttctgcgacaccatgaacagtcttaccctcccgtcagaagtcaacctctgcaacatagatatcttcaacccaaaatacgactgcaaaatcatgacctcaaaaaccgacgtttcctcatccgttatcacctccctcggcgcaatcgtcagctgctacggcaagacaaagtgcacggcttcaaacaaaaaccgcggaatcatcaagacattcagcaacggctgcgactacgtatccaacaaaggagtggacacagtctccgttggaaacaccctctactgcgtaaacaaacaagaaggccaatcactctacgtcaaaggcgaacccatcatcaacttctacgacccactcgtcttcccctccgacgagttcgacgcctcaatcagccaagtcaacgagaaaattaaccagtcactcgccttcatacgcaaatccgacgaacttctacacaacgtaaacgtcggaaaatcaaccacaaacatcatgattaccacaattatcatagtcatcatagtaatcctcctgctactcatagcagtcggactcttcctatactgcaaagcccgctccacccctgtcaccctatccaaagaccaactttccggcatcaacaacatagccttttccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14005 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut1 (opt1)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14006 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut1 (opt1)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14007 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut1 (opt2)
  source 1..1897: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14008 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut1 (opt3)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagaccaactcagtggcattaataacatcgcattctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14009 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut1 (opt4)
  source 1..1897: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14010 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut1 (opt5)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagaccaactctctgggatcaataacattgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14011 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut1 (opt6)
  source 1..1897: mol_type = other RNA
gggagagtcccgcagtcggcgtccagcggctctgcttgttcgtgtgtgtgtcgttgcaggccttattcaagcttaccatggaacttccaattctaaaaaccaatgctataacaacaatattagcagcagttacattatgcttcgcctcatcacaaaatatcacagaagaattttaccaatccacatgctcagcagtatctaaagggtacctaggagccctacgaacaggatggtacacatcagtaataacaatagaactctcaaacatcaaagaaaacaaatgcaatggaacagacgctaaagtaaaattaataaaacaagaactagacaaatacaaaaacgccgtcaccgaacttcagttactcatgcaaagcacacctgcagcaggatcaggttcagcaatatgctcaggaatagcagtttgcaaagtattacacctagaaggtgaagtcaacaaaataaaaaacgcacttctaagtactaacaaagctgtagtatcattatcaaacggagtatccgtactaacctttaaagtcctagacctaaaaaactacatagacaaacaactactcccaatactcaataaacaatcctgctcaattcccaacatcgaaacagtaatagaatttcaacaaaaaaacaatcgccttctagaaataacaagagaattttcagtcaacgccggagtaacaacaccagtatcaacatatatgctaacaaacagtgaactattatccttaataaacgacatgccaataacaaatgaccaaaaaaaactaatgtccaataatgtccaaatagtaagacaacaaagctattcaattatgtgtataataaaagaagaagtattagcatacgtagttcaactaccactatatggcgttatagacacaccatgctggaaattacacacaagcccactatgcacaacaaatacaaaagaaggatccaacatttgcttaactagaactgacagaggatggtactgcgacaacgctggatcagtctctttcttcccacaagcagaaacctgtaaagtacaatcaaatagagtcttctgcgacacaatgaactcactaactctcccatctgaagtaaacttatgcaacatcgatatatttaacccaaaatacgattgtaaaataatgacatccaaaacagacgtttcatcaagcgtaatcacctccctcggagcaatcgtaagctgctacggtaaaacaaaatgcacagcatccaacaaaaacagaggcatcataaaaacattctcaaacggatgtgactatgtatcaaacaaaggagtagacacagtttcagtaggcaataccttatactgtgtcaataaacaagaaggacaatcactatatgtaaaaggagaacctataataaacttctacgaccccctcgtcttccctagcgatgaatttgacgcatcaatatcgcaagtaaacgaaaaaataaaccaatcattagcctttataagaaaatcagacgaattattacacaacgtaaacgtggggaaaagcacaactaacatcatgataacaactatcataattgtaatcatcgtcatcctattactcctaatcgcagtaggactattcctatactgcaaagctagatcaacaccagtcaccctatcgaaagatcaattgtcaggaataaacaatatagccttttcaaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14012 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut1 (opt11)
  source 1..1897: mol_type = other RNA
gggagagtcccgcagtcggcgtccagcggctctgcttgttcgtgtgtgtgtcgttgcaggccttattcaagcttaccatggaactccccatcctcaaaacgaacgccatcacaaccatcctcgccgccgtcaccctctgcttcgcgtcatcccaaaacataactgaagagttctatcaatcaacctgctccgcagtctcaaaaggctacctcggcgccctacggaccggctggtacacaagcgtcatcacaatagaactttccaacatcaaagaaaacaaatgtaacggcaccgacgcaaaagtcaaactcataaaacaagaactagacaaatataaaaacgccgtaactgaactacaactcctcatgcaatcaactcctgcagccggtagcggctccgcaatctgctcaggcatcgcagtctgcaaagtcttacacctagaaggcgaagtcaacaaaatcaagaacgccctactatccacaaacaaagcagtagtctctctatccaacggagtctccgtcctcacattcaaagtactcgacctaaagaactacatcgacaaacaactactaccaatcttaaacaaacaatcctgctcaatccctaacattgaaaccgtcatagagttccaacagaaaaacaaccgcctcctcgaaataaccagagagttctcagtcaacgccggcgtcaccaccccggtctcaacctacatgctaaccaactctgaacttctcagcctaatcaacgacatgcccattaccaacgaccaaaagaaactcatgtccaataacgtccaaatcgttcgacaacaatcctactcaatcatgtgcatcataaaagaagaagtcctagcatacgtcgtccaactcccactatacggcgtaatcgacaccccctgctggaaactccacacctcccctctctgtaccaccaacaccaaagaagggtccaacatctgcctcacgcgcaccgaccgaggctggtattgcgacaatgcaggctctgtctccttcttcccccaagccgaaacctgcaaagtccaatctaaccgcgtcttctgcgacaccatgaacagtcttaccctcccgtcagaagtcaacctctgcaacatagatatcttcaacccaaaatacgactgcaaaatcatgacctcaaaaaccgacgtttcctcatccgttatcacctccctcggcgcaatcgtcagctgctacggcaagacaaagtgcacggcttcaaacaaaaaccgcggaatcatcaagacattcagcaacggctgcgactacgtatccaacaaaggagtggacacagtctccgttggaaacaccctctactgcgtaaacaaacaagaaggccaatcactctacgtcaaaggcgaacccatcatcaacttctacgacccactcgtcttcccctccgacgagttcgacgcctcaatcagccaagtcaacgagaaaattaaccagtcactcgccttcatacgcaaatccgacgaacttctacacaacgtaaacgtcggaaaatcaaccacaaacatcatgattaccacaattatcatagtcatcatagtaatcctcctgctactcatagcagtcggactcttcctatactgcaaagcccgctccacccctgtcaccctatccaaagaccaactttccggcatcaacaacatagccttttccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14013 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut1 (opt1)
  source 1..1948: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14014 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut1 (opt1)
  source 1..1948: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14015 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut1 (opt2)
  source 1..1948: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14016 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut1 (opt3)
  source 1..1948: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagaccaactcagtggcattaataacatcgcattctctaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14017 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut1 (opt4)
  source 1..1948: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14018 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut1 (opt5)
  source 1..1948: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagaccaactctctgggatcaataacattgctttctccaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14019 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut1 (opt6)
  source 1..1948: mol_type = other RNA
gggagagtcccgcagtcggcgtccagcggctctgcttgttcgtgtgtgtgtcgttgcaggccttattcaagcttaccatggaacttccaattctaaaaaccaatgctataacaacaatattagcagcagttacattatgcttcgcctcatcacaaaatatcacagaagaattttaccaatccacatgctcagcagtatctaaagggtacctaggagccctacgaacaggatggtacacatcagtaataacaatagaactctcaaacatcaaagaaaacaaatgcaatggaacagacgctaaagtaaaattaataaaacaagaactagacaaatacaaaaacgccgtcaccgaacttcagttactcatgcaaagcacacctgcagcaggatcaggttcagcaatatgctcaggaatagcagtttgcaaagtattacacctagaaggtgaagtcaacaaaataaaaaacgcacttctaagtactaacaaagctgtagtatcattatcaaacggagtatccgtactaacctttaaagtcctagacctaaaaaactacatagacaaacaactactcccaatactcaataaacaatcctgctcaattcccaacatcgaaacagtaatagaatttcaacaaaaaaacaatcgccttctagaaataacaagagaattttcagtcaacgccggagtaacaacaccagtatcaacatatatgctaacaaacagtgaactattatccttaataaacgacatgccaataacaaatgaccaaaaaaaactaatgtccaataatgtccaaatagtaagacaacaaagctattcaattatgtgtataataaaagaagaagtattagcatacgtagttcaactaccactatatggcgttatagacacaccatgctggaaattacacacaagcccactatgcacaacaaatacaaaagaaggatccaacatttgcttaactagaactgacagaggatggtactgcgacaacgctggatcagtctctttcttcccacaagcagaaacctgtaaagtacaatcaaatagagtcttctgcgacacaatgaactcactaactctcccatctgaagtaaacttatgcaacatcgatatatttaacccaaaatacgattgtaaaataatgacatccaaaacagacgtttcatcaagcgtaatcacctccctcggagcaatcgtaagctgctacggtaaaacaaaatgcacagcatccaacaaaaacagaggcatcataaaaacattctcaaacggatgtgactatgtatcaaacaaaggagtagacacagtttcagtaggcaataccttatactgtgtcaataaacaagaaggacaatcactatatgtaaaaggagaacctataataaacttctacgaccccctcgtcttccctagcgatgaatttgacgcatcaatatcgcaagtaaacgaaaaaataaaccaatcattagcctttataagaaaatcagacgaattattacacaacgtaaacgtggggaaaagcacaactaacatcatgataacaactatcataattgtaatcatcgtcatcctattactcctaatcgcagtaggactattcctatactgcaaagctagatcaacaccagtcaccctatcgaaagatcaattgtcaggaataaacaatatagccttttcaaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14020 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut1 (opt11)
  source 1..1948: mol_type = other RNA
gggagagtcccgcagtcggcgtccagcggctctgcttgttcgtgtgtgtgtcgttgcaggccttattcaagcttaccatggaactccccatcctcaaaacgaacgccatcacaaccatcctcgccgccgtcaccctctgcttcgcgtcatcccaaaacataactgaagagttctatcaatcaacctgctccgcagtctcaaaaggctacctcggcgccctacggaccggctggtacacaagcgtcatcacaatagaactttccaacatcaaagaaaacaaatgtaacggcaccgacgcaaaagtcaaactcataaaacaagaactagacaaatataaaaacgccgtaactgaactacaactcctcatgcaatcaactcctgcagccggtagcggctccgcaatctgctcaggcatcgcagtctgcaaagtcttacacctagaaggcgaagtcaacaaaatcaagaacgccctactatccacaaacaaagcagtagtctctctatccaacggagtctccgtcctcacattcaaagtactcgacctaaagaactacatcgacaaacaactactaccaatcttaaacaaacaatcctgctcaatccctaacattgaaaccgtcatagagttccaacagaaaaacaaccgcctcctcgaaataaccagagagttctcagtcaacgccggcgtcaccaccccggtctcaacctacatgctaaccaactctgaacttctcagcctaatcaacgacatgcccattaccaacgaccaaaagaaactcatgtccaataacgtccaaatcgttcgacaacaatcctactcaatcatgtgcatcataaaagaagaagtcctagcatacgtcgtccaactcccactatacggcgtaatcgacaccccctgctggaaactccacacctcccctctctgtaccaccaacaccaaagaagggtccaacatctgcctcacgcgcaccgaccgaggctggtattgcgacaatgcaggctctgtctccttcttcccccaagccgaaacctgcaaagtccaatctaaccgcgtcttctgcgacaccatgaacagtcttaccctcccgtcagaagtcaacctctgcaacatagatatcttcaacccaaaatacgactgcaaaatcatgacctcaaaaaccgacgtttcctcatccgttatcacctccctcggcgcaatcgtcagctgctacggcaagacaaagtgcacggcttcaaacaaaaaccgcggaatcatcaagacattcagcaacggctgcgactacgtatccaacaaaggagtggacacagtctccgttggaaacaccctctactgcgtaaacaaacaagaaggccaatcactctacgtcaaaggcgaacccatcatcaacttctacgacccactcgtcttcccctccgacgagttcgacgcctcaatcagccaagtcaacgagaaaattaaccagtcactcgccttcatacgcaaatccgacgaacttctacacaacgtaaacgtcggaaaatcaaccacaaacatcatgattaccacaattatcatagtcatcatagtaatcctcctgctactcatagcagtcggactcttcctatactgcaaagcccgctccacccctgtcaccctatccaaagaccaactttccggcatcaacaacatagccttttccaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14021 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut1 (opt1)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14022 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut1 (opt1)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14023 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut1 (opt2)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14024 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut1 (opt3)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagaccaactcagtggcattaataacatcgcattctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14025 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut1 (opt4)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14026 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut1 (opt5)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagaccaactctctgggatcaataacattgctttctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14027 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut1 (opt6)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttccaattctaaaaaccaatgctataacaacaatattagcagcagttacattatgcttcgcctcatcacaaaatatcacagaagaattttaccaatccacatgctcagcagtatctaaagggtacctaggagccctacgaacaggatggtacacatcagtaataacaatagaactctcaaacatcaaagaaaacaaatgcaatggaacagacgctaaagtaaaattaataaaacaagaactagacaaatacaaaaacgccgtcaccgaacttcagttactcatgcaaagcacacctgcagcaggatcaggttcagcaatatgctcaggaatagcagtttgcaaagtattacacctagaaggtgaagtcaacaaaataaaaaacgcacttctaagtactaacaaagctgtagtatcattatcaaacggagtatccgtactaacctttaaagtcctagacctaaaaaactacatagacaaacaactactcccaatactcaataaacaatcctgctcaattcccaacatcgaaacagtaatagaatttcaacaaaaaaacaatcgccttctagaaataacaagagaattttcagtcaacgccggagtaacaacaccagtatcaacatatatgctaacaaacagtgaactattatccttaataaacgacatgccaataacaaatgaccaaaaaaaactaatgtccaataatgtccaaatagtaagacaacaaagctattcaattatgtgtataataaaagaagaagtattagcatacgtagttcaactaccactatatggcgttatagacacaccatgctggaaattacacacaagcccactatgcacaacaaatacaaaagaaggatccaacatttgcttaactagaactgacagaggatggtactgcgacaacgctggatcagtctctttcttcccacaagcagaaacctgtaaagtacaatcaaatagagtcttctgcgacacaatgaactcactaactctcccatctgaagtaaacttatgcaacatcgatatatttaacccaaaatacgattgtaaaataatgacatccaaaacagacgtttcatcaagcgtaatcacctccctcggagcaatcgtaagctgctacggtaaaacaaaatgcacagcatccaacaaaaacagaggcatcataaaaacattctcaaacggatgtgactatgtatcaaacaaaggagtagacacagtttcagtaggcaataccttatactgtgtcaataaacaagaaggacaatcactatatgtaaaaggagaacctataataaacttctacgaccccctcgtcttccctagcgatgaatttgacgcatcaatatcgcaagtaaacgaaaaaataaaccaatcattagcctttataagaaaatcagacgaattattacacaacgtaaacgtggggaaaagcacaactaacatcatgataacaactatcataattgtaatcatcgtcatcctattactcctaatcgcagtaggactattcctatactgcaaagctagatcaacaccagtcaccctatcgaaagatcaattgtcaggaataaacaatatagccttttcaaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14028 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut1 (opt11)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactccccatcctcaaaacgaacgccatcacaaccatcctcgccgccgtcaccctctgcttcgcgtcatcccaaaacataactgaagagttctatcaatcaacctgctccgcagtctcaaaaggctacctcggcgccctacggaccggctggtacacaagcgtcatcacaatagaactttccaacatcaaagaaaacaaatgtaacggcaccgacgcaaaagtcaaactcataaaacaagaactagacaaatataaaaacgccgtaactgaactacaactcctcatgcaatcaactcctgcagccggtagcggctccgcaatctgctcaggcatcgcagtctgcaaagtcttacacctagaaggcgaagtcaacaaaatcaagaacgccctactatccacaaacaaagcagtagtctctctatccaacggagtctccgtcctcacattcaaagtactcgacctaaagaactacatcgacaaacaactactaccaatcttaaacaaacaatcctgctcaatccctaacattgaaaccgtcatagagttccaacagaaaaacaaccgcctcctcgaaataaccagagagttctcagtcaacgccggcgtcaccaccccggtctcaacctacatgctaaccaactctgaacttctcagcctaatcaacgacatgcccattaccaacgaccaaaagaaactcatgtccaataacgtccaaatcgttcgacaacaatcctactcaatcatgtgcatcataaaagaagaagtcctagcatacgtcgtccaactcccactatacggcgtaatcgacaccccctgctggaaactccacacctcccctctctgtaccaccaacaccaaagaagggtccaacatctgcctcacgcgcaccgaccgaggctggtattgcgacaatgcaggctctgtctccttcttcccccaagccgaaacctgcaaagtccaatctaaccgcgtcttctgcgacaccatgaacagtcttaccctcccgtcagaagtcaacctctgcaacatagatatcttcaacccaaaatacgactgcaaaatcatgacctcaaaaaccgacgtttcctcatccgttatcacctccctcggcgcaatcgtcagctgctacggcaagacaaagtgcacggcttcaaacaaaaaccgcggaatcatcaagacattcagcaacggctgcgactacgtatccaacaaaggagtggacacagtctccgttggaaacaccctctactgcgtaaacaaacaagaaggccaatcactctacgtcaaaggcgaacccatcatcaacttctacgacccactcgtcttcccctccgacgagttcgacgcctcaatcagccaagtcaacgagaaaattaaccagtcactcgccttcatacgcaaatccgacgaacttctacacaacgtaaacgtcggaaaatcaaccacaaacatcatgattaccacaattatcatagtcatcatagtaatcctcctgctactcatagcagtcggactcttcctatactgcaaagcccgctccacccctgtcaccctatccaaagaccaactttccggcatcaacaacatagccttttccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14029 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut1 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14030 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut1 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14031 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut1 (opt2)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14032 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut1 (opt3)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagaccaactcagtggcattaataacatcgcattctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14033 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut1 (opt4)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14034 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut1 (opt5)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagaccaactctctgggatcaataacattgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14035 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut1 (opt6)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaacttccaattctaaaaaccaatgctataacaacaatattagcagcagttacattatgcttcgcctcatcacaaaatatcacagaagaattttaccaatccacatgctcagcagtatctaaagggtacctaggagccctacgaacaggatggtacacatcagtaataacaatagaactctcaaacatcaaagaaaacaaatgcaatggaacagacgctaaagtaaaattaataaaacaagaactagacaaatacaaaaacgccgtcaccgaacttcagttactcatgcaaagcacacctgcagcaggatcaggttcagcaatatgctcaggaatagcagtttgcaaagtattacacctagaaggtgaagtcaacaaaataaaaaacgcacttctaagtactaacaaagctgtagtatcattatcaaacggagtatccgtactaacctttaaagtcctagacctaaaaaactacatagacaaacaactactcccaatactcaataaacaatcctgctcaattcccaacatcgaaacagtaatagaatttcaacaaaaaaacaatcgccttctagaaataacaagagaattttcagtcaacgccggagtaacaacaccagtatcaacatatatgctaacaaacagtgaactattatccttaataaacgacatgccaataacaaatgaccaaaaaaaactaatgtccaataatgtccaaatagtaagacaacaaagctattcaattatgtgtataataaaagaagaagtattagcatacgtagttcaactaccactatatggcgttatagacacaccatgctggaaattacacacaagcccactatgcacaacaaatacaaaagaaggatccaacatttgcttaactagaactgacagaggatggtactgcgacaacgctggatcagtctctttcttcccacaagcagaaacctgtaaagtacaatcaaatagagtcttctgcgacacaatgaactcactaactctcccatctgaagtaaacttatgcaacatcgatatatttaacccaaaatacgattgtaaaataatgacatccaaaacagacgtttcatcaagcgtaatcacctccctcggagcaatcgtaagctgctacggtaaaacaaaatgcacagcatccaacaaaaacagaggcatcataaaaacattctcaaacggatgtgactatgtatcaaacaaaggagtagacacagtttcagtaggcaataccttatactgtgtcaataaacaagaaggacaatcactatatgtaaaaggagaacctataataaacttctacgaccccctcgtcttccctagcgatgaatttgacgcatcaatatcgcaagtaaacgaaaaaataaaccaatcattagcctttataagaaaatcagacgaattattacacaacgtaaacgtggggaaaagcacaactaacatcatgataacaactatcataattgtaatcatcgtcatcctattactcctaatcgcagtaggactattcctatactgcaaagctagatcaacaccagtcaccctatcgaaagatcaattgtcaggaataaacaatatagccttttcaaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14036 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut1 (opt11)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaactccccatcctcaaaacgaacgccatcacaaccatcctcgccgccgtcaccctctgcttcgcgtcatcccaaaacataactgaagagttctatcaatcaacctgctccgcagtctcaaaaggctacctcggcgccctacggaccggctggtacacaagcgtcatcacaatagaactttccaacatcaaagaaaacaaatgtaacggcaccgacgcaaaagtcaaactcataaaacaagaactagacaaatataaaaacgccgtaactgaactacaactcctcatgcaatcaactcctgcagccggtagcggctccgcaatctgctcaggcatcgcagtctgcaaagtcttacacctagaaggcgaagtcaacaaaatcaagaacgccctactatccacaaacaaagcagtagtctctctatccaacggagtctccgtcctcacattcaaagtactcgacctaaagaactacatcgacaaacaactactaccaatcttaaacaaacaatcctgctcaatccctaacattgaaaccgtcatagagttccaacagaaaaacaaccgcctcctcgaaataaccagagagttctcagtcaacgccggcgtcaccaccccggtctcaacctacatgctaaccaactctgaacttctcagcctaatcaacgacatgcccattaccaacgaccaaaagaaactcatgtccaataacgtccaaatcgttcgacaacaatcctactcaatcatgtgcatcataaaagaagaagtcctagcatacgtcgtccaactcccactatacggcgtaatcgacaccccctgctggaaactccacacctcccctctctgtaccaccaacaccaaagaagggtccaacatctgcctcacgcgcaccgaccgaggctggtattgcgacaatgcaggctctgtctccttcttcccccaagccgaaacctgcaaagtccaatctaaccgcgtcttctgcgacaccatgaacagtcttaccctcccgtcagaagtcaacctctgcaacatagatatcttcaacccaaaatacgactgcaaaatcatgacctcaaaaaccgacgtttcctcatccgttatcacctccctcggcgcaatcgtcagctgctacggcaagacaaagtgcacggcttcaaacaaaaaccgcggaatcatcaagacattcagcaacggctgcgactacgtatccaacaaaggagtggacacagtctccgttggaaacaccctctactgcgtaaacaaacaagaaggccaatcactctacgtcaaaggcgaacccatcatcaacttctacgacccactcgtcttcccctccgacgagttcgacgcctcaatcagccaagtcaacgagaaaattaaccagtcactcgccttcatacgcaaatccgacgaacttctacacaacgtaaacgtcggaaaatcaaccacaaacatcatgattaccacaattatcatagtcatcatagtaatcctcctgctactcatagcagtcggactcttcctatactgcaaagcccgctccacccctgtcaccctatccaaagaccaactttccggcatcaacaacatagccttttccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14037 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut1 (opt1)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14038 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut1 (opt1)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14039 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut1 (opt2)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14040 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut1 (opt3)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagaccaactcagtggcattaataacatcgcattctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14041 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut1 (opt4)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14042 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut1 (opt5)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagaccaactctctgggatcaataacattgctttctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14043 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut1 (opt6)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttccaattctaaaaaccaatgctataacaacaatattagcagcagttacattatgcttcgcctcatcacaaaatatcacagaagaattttaccaatccacatgctcagcagtatctaaagggtacctaggagccctacgaacaggatggtacacatcagtaataacaatagaactctcaaacatcaaagaaaacaaatgcaatggaacagacgctaaagtaaaattaataaaacaagaactagacaaatacaaaaacgccgtcaccgaacttcagttactcatgcaaagcacacctgcagcaggatcaggttcagcaatatgctcaggaatagcagtttgcaaagtattacacctagaaggtgaagtcaacaaaataaaaaacgcacttctaagtactaacaaagctgtagtatcattatcaaacggagtatccgtactaacctttaaagtcctagacctaaaaaactacatagacaaacaactactcccaatactcaataaacaatcctgctcaattcccaacatcgaaacagtaatagaatttcaacaaaaaaacaatcgccttctagaaataacaagagaattttcagtcaacgccggagtaacaacaccagtatcaacatatatgctaacaaacagtgaactattatccttaataaacgacatgccaataacaaatgaccaaaaaaaactaatgtccaataatgtccaaatagtaagacaacaaagctattcaattatgtgtataataaaagaagaagtattagcatacgtagttcaactaccactatatggcgttatagacacaccatgctggaaattacacacaagcccactatgcacaacaaatacaaaagaaggatccaacatttgcttaactagaactgacagaggatggtactgcgacaacgctggatcagtctctttcttcccacaagcagaaacctgtaaagtacaatcaaatagagtcttctgcgacacaatgaactcactaactctcccatctgaagtaaacttatgcaacatcgatatatttaacccaaaatacgattgtaaaataatgacatccaaaacagacgtttcatcaagcgtaatcacctccctcggagcaatcgtaagctgctacggtaaaacaaaatgcacagcatccaacaaaaacagaggcatcataaaaacattctcaaacggatgtgactatgtatcaaacaaaggagtagacacagtttcagtaggcaataccttatactgtgtcaataaacaagaaggacaatcactatatgtaaaaggagaacctataataaacttctacgaccccctcgtcttccctagcgatgaatttgacgcatcaatatcgcaagtaaacgaaaaaataaaccaatcattagcctttataagaaaatcagacgaattattacacaacgtaaacgtggggaaaagcacaactaacatcatgataacaactatcataattgtaatcatcgtcatcctattactcctaatcgcagtaggactattcctatactgcaaagctagatcaacaccagtcaccctatcgaaagatcaattgtcaggaataaacaatatagccttttcaaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14044 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut1 (opt11)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactccccatcctcaaaacgaacgccatcacaaccatcctcgccgccgtcaccctctgcttcgcgtcatcccaaaacataactgaagagttctatcaatcaacctgctccgcagtctcaaaaggctacctcggcgccctacggaccggctggtacacaagcgtcatcacaatagaactttccaacatcaaagaaaacaaatgtaacggcaccgacgcaaaagtcaaactcataaaacaagaactagacaaatataaaaacgccgtaactgaactacaactcctcatgcaatcaactcctgcagccggtagcggctccgcaatctgctcaggcatcgcagtctgcaaagtcttacacctagaaggcgaagtcaacaaaatcaagaacgccctactatccacaaacaaagcagtagtctctctatccaacggagtctccgtcctcacattcaaagtactcgacctaaagaactacatcgacaaacaactactaccaatcttaaacaaacaatcctgctcaatccctaacattgaaaccgtcatagagttccaacagaaaaacaaccgcctcctcgaaataaccagagagttctcagtcaacgccggcgtcaccaccccggtctcaacctacatgctaaccaactctgaacttctcagcctaatcaacgacatgcccattaccaacgaccaaaagaaactcatgtccaataacgtccaaatcgttcgacaacaatcctactcaatcatgtgcatcataaaagaagaagtcctagcatacgtcgtccaactcccactatacggcgtaatcgacaccccctgctggaaactccacacctcccctctctgtaccaccaacaccaaagaagggtccaacatctgcctcacgcgcaccgaccgaggctggtattgcgacaatgcaggctctgtctccttcttcccccaagccgaaacctgcaaagtccaatctaaccgcgtcttctgcgacaccatgaacagtcttaccctcccgtcagaagtcaacctctgcaacatagatatcttcaacccaaaatacgactgcaaaatcatgacctcaaaaaccgacgtttcctcatccgttatcacctccctcggcgcaatcgtcagctgctacggcaagacaaagtgcacggcttcaaacaaaaaccgcggaatcatcaagacattcagcaacggctgcgactacgtatccaacaaaggagtggacacagtctccgttggaaacaccctctactgcgtaaacaaacaagaaggccaatcactctacgtcaaaggcgaacccatcatcaacttctacgacccactcgtcttcccctccgacgagttcgacgcctcaatcagccaagtcaacgagaaaattaaccagtcactcgccttcatacgcaaatccgacgaacttctacacaacgtaaacgtcggaaaatcaaccacaaacatcatgattaccacaattatcatagtcatcatagtaatcctcctgctactcatagcagtcggactcttcctatactgcaaagcccgctccacccctgtcaccctatccaaagaccaactttccggcatcaacaacatagccttttccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14045 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut1 (opt1)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14046 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut1 (opt1)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14047 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut1 (opt2)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14048 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut1 (opt3)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagaccaactcagtggcattaataacatcgcattctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14049 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut1 (opt4)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14050 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut1 (opt5)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagaccaactctctgggatcaataacattgctttctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14051 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut1 (opt6)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggaacttccaattctaaaaaccaatgctataacaacaatattagcagcagttacattatgcttcgcctcatcacaaaatatcacagaagaattttaccaatccacatgctcagcagtatctaaagggtacctaggagccctacgaacaggatggtacacatcagtaataacaatagaactctcaaacatcaaagaaaacaaatgcaatggaacagacgctaaagtaaaattaataaaacaagaactagacaaatacaaaaacgccgtcaccgaacttcagttactcatgcaaagcacacctgcagcaggatcaggttcagcaatatgctcaggaatagcagtttgcaaagtattacacctagaaggtgaagtcaacaaaataaaaaacgcacttctaagtactaacaaagctgtagtatcattatcaaacggagtatccgtactaacctttaaagtcctagacctaaaaaactacatagacaaacaactactcccaatactcaataaacaatcctgctcaattcccaacatcgaaacagtaatagaatttcaacaaaaaaacaatcgccttctagaaataacaagagaattttcagtcaacgccggagtaacaacaccagtatcaacatatatgctaacaaacagtgaactattatccttaataaacgacatgccaataacaaatgaccaaaaaaaactaatgtccaataatgtccaaatagtaagacaacaaagctattcaattatgtgtataataaaagaagaagtattagcatacgtagttcaactaccactatatggcgttatagacacaccatgctggaaattacacacaagcccactatgcacaacaaatacaaaagaaggatccaacatttgcttaactagaactgacagaggatggtactgcgacaacgctggatcagtctctttcttcccacaagcagaaacctgtaaagtacaatcaaatagagtcttctgcgacacaatgaactcactaactctcccatctgaagtaaacttatgcaacatcgatatatttaacccaaaatacgattgtaaaataatgacatccaaaacagacgtttcatcaagcgtaatcacctccctcggagcaatcgtaagctgctacggtaaaacaaaatgcacagcatccaacaaaaacagaggcatcataaaaacattctcaaacggatgtgactatgtatcaaacaaaggagtagacacagtttcagtaggcaataccttatactgtgtcaataaacaagaaggacaatcactatatgtaaaaggagaacctataataaacttctacgaccccctcgtcttccctagcgatgaatttgacgcatcaatatcgcaagtaaacgaaaaaataaaccaatcattagcctttataagaaaatcagacgaattattacacaacgtaaacgtggggaaaagcacaactaacatcatgataacaactatcataattgtaatcatcgtcatcctattactcctaatcgcagtaggactattcctatactgcaaagctagatcaacaccagtcaccctatcgaaagatcaattgtcaggaataaacaatatagccttttcaaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14052 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut1 (opt11)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggaactccccatcctcaaaacgaacgccatcacaaccatcctcgccgccgtcaccctctgcttcgcgtcatcccaaaacataactgaagagttctatcaatcaacctgctccgcagtctcaaaaggctacctcggcgccctacggaccggctggtacacaagcgtcatcacaatagaactttccaacatcaaagaaaacaaatgtaacggcaccgacgcaaaagtcaaactcataaaacaagaactagacaaatataaaaacgccgtaactgaactacaactcctcatgcaatcaactcctgcagccggtagcggctccgcaatctgctcaggcatcgcagtctgcaaagtcttacacctagaaggcgaagtcaacaaaatcaagaacgccctactatccacaaacaaagcagtagtctctctatccaacggagtctccgtcctcacattcaaagtactcgacctaaagaactacatcgacaaacaactactaccaatcttaaacaaacaatcctgctcaatccctaacattgaaaccgtcatagagttccaacagaaaaacaaccgcctcctcgaaataaccagagagttctcagtcaacgccggcgtcaccaccccggtctcaacctacatgctaaccaactctgaacttctcagcctaatcaacgacatgcccattaccaacgaccaaaagaaactcatgtccaataacgtccaaatcgttcgacaacaatcctactcaatcatgtgcatcataaaagaagaagtcctagcatacgtcgtccaactcccactatacggcgtaatcgacaccccctgctggaaactccacacctcccctctctgtaccaccaacaccaaagaagggtccaacatctgcctcacgcgcaccgaccgaggctggtattgcgacaatgcaggctctgtctccttcttcccccaagccgaaacctgcaaagtccaatctaaccgcgtcttctgcgacaccatgaacagtcttaccctcccgtcagaagtcaacctctgcaacatagatatcttcaacccaaaatacgactgcaaaatcatgacctcaaaaaccgacgtttcctcatccgttatcacctccctcggcgcaatcgtcagctgctacggcaagacaaagtgcacggcttcaaacaaaaaccgcggaatcatcaagacattcagcaacggctgcgactacgtatccaacaaaggagtggacacagtctccgttggaaacaccctctactgcgtaaacaaacaagaaggccaatcactctacgtcaaaggcgaacccatcatcaacttctacgacccactcgtcttcccctccgacgagttcgacgcctcaatcagccaagtcaacgagaaaattaaccagtcactcgccttcatacgcaaatccgacgaacttctacacaacgtaaacgtcggaaaatcaaccacaaacatcatgattaccacaattatcatagtcatcatagtaatcctcctgctactcatagcagtcggactcttcctatactgcaaagcccgctccacccctgtcaccctatccaaagaccaactttccggcatcaacaacatagccttttccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14053 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut1 (opt1)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14054 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut1 (opt1)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14055 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut1 (opt2)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14056 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut1 (opt3)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagaccaactcagtggcattaataacatcgcattctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14057 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut1 (opt4)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14058 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut1 (opt5)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagaccaactctctgggatcaataacattgctttctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14059 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut1 (opt6)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggaacttccaattctaaaaaccaatgctataacaacaatattagcagcagttacattatgcttcgcctcatcacaaaatatcacagaagaattttaccaatccacatgctcagcagtatctaaagggtacctaggagccctacgaacaggatggtacacatcagtaataacaatagaactctcaaacatcaaagaaaacaaatgcaatggaacagacgctaaagtaaaattaataaaacaagaactagacaaatacaaaaacgccgtcaccgaacttcagttactcatgcaaagcacacctgcagcaggatcaggttcagcaatatgctcaggaatagcagtttgcaaagtattacacctagaaggtgaagtcaacaaaataaaaaacgcacttctaagtactaacaaagctgtagtatcattatcaaacggagtatccgtactaacctttaaagtcctagacctaaaaaactacatagacaaacaactactcccaatactcaataaacaatcctgctcaattcccaacatcgaaacagtaatagaatttcaacaaaaaaacaatcgccttctagaaataacaagagaattttcagtcaacgccggagtaacaacaccagtatcaacatatatgctaacaaacagtgaactattatccttaataaacgacatgccaataacaaatgaccaaaaaaaactaatgtccaataatgtccaaatagtaagacaacaaagctattcaattatgtgtataataaaagaagaagtattagcatacgtagttcaactaccactatatggcgttatagacacaccatgctggaaattacacacaagcccactatgcacaacaaatacaaaagaaggatccaacatttgcttaactagaactgacagaggatggtactgcgacaacgctggatcagtctctttcttcccacaagcagaaacctgtaaagtacaatcaaatagagtcttctgcgacacaatgaactcactaactctcccatctgaagtaaacttatgcaacatcgatatatttaacccaaaatacgattgtaaaataatgacatccaaaacagacgtttcatcaagcgtaatcacctccctcggagcaatcgtaagctgctacggtaaaacaaaatgcacagcatccaacaaaaacagaggcatcataaaaacattctcaaacggatgtgactatgtatcaaacaaaggagtagacacagtttcagtaggcaataccttatactgtgtcaataaacaagaaggacaatcactatatgtaaaaggagaacctataataaacttctacgaccccctcgtcttccctagcgatgaatttgacgcatcaatatcgcaagtaaacgaaaaaataaaccaatcattagcctttataagaaaatcagacgaattattacacaacgtaaacgtggggaaaagcacaactaacatcatgataacaactatcataattgtaatcatcgtcatcctattactcctaatcgcagtaggactattcctatactgcaaagctagatcaacaccagtcaccctatcgaaagatcaattgtcaggaataaacaatatagccttttcaaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14060 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut1 (opt11)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggaactccccatcctcaaaacgaacgccatcacaaccatcctcgccgccgtcaccctctgcttcgcgtcatcccaaaacataactgaagagttctatcaatcaacctgctccgcagtctcaaaaggctacctcggcgccctacggaccggctggtacacaagcgtcatcacaatagaactttccaacatcaaagaaaacaaatgtaacggcaccgacgcaaaagtcaaactcataaaacaagaactagacaaatataaaaacgccgtaactgaactacaactcctcatgcaatcaactcctgcagccggtagcggctccgcaatctgctcaggcatcgcagtctgcaaagtcttacacctagaaggcgaagtcaacaaaatcaagaacgccctactatccacaaacaaagcagtagtctctctatccaacggagtctccgtcctcacattcaaagtactcgacctaaagaactacatcgacaaacaactactaccaatcttaaacaaacaatcctgctcaatccctaacattgaaaccgtcatagagttccaacagaaaaacaaccgcctcctcgaaataaccagagagttctcagtcaacgccggcgtcaccaccccggtctcaacctacatgctaaccaactctgaacttctcagcctaatcaacgacatgcccattaccaacgaccaaaagaaactcatgtccaataacgtccaaatcgttcgacaacaatcctactcaatcatgtgcatcataaaagaagaagtcctagcatacgtcgtccaactcccactatacggcgtaatcgacaccccctgctggaaactccacacctcccctctctgtaccaccaacaccaaagaagggtccaacatctgcctcacgcgcaccgaccgaggctggtattgcgacaatgcaggctctgtctccttcttcccccaagccgaaacctgcaaagtccaatctaaccgcgtcttctgcgacaccatgaacagtcttaccctcccgtcagaagtcaacctctgcaacatagatatcttcaacccaaaatacgactgcaaaatcatgacctcaaaaaccgacgtttcctcatccgttatcacctccctcggcgcaatcgtcagctgctacggcaagacaaagtgcacggcttcaaacaaaaaccgcggaatcatcaagacattcagcaacggctgcgactacgtatccaacaaaggagtggacacagtctccgttggaaacaccctctactgcgtaaacaaacaagaaggccaatcactctacgtcaaaggcgaacccatcatcaacttctacgacccactcgtcttcccctccgacgagttcgacgcctcaatcagccaagtcaacgagaaaattaaccagtcactcgccttcatacgcaaatccgacgaacttctacacaacgtaaacgtcggaaaatcaaccacaaacatcatgattaccacaattatcatagtcatcatagtaatcctcctgctactcatagcagtcggactcttcctatactgcaaagcccgctccacccctgtcaccctatccaaagaccaactttccggcatcaacaacatagccttttccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14061 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut1 (opt1)
  source 1..1897: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14062 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut1 (opt1)
  source 1..1897: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14063 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut1 (opt2)
  source 1..1897: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14064 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut1 (opt3)
  source 1..1897: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagaccaactcagtggcattaataacatcgcattctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14065 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut1 (opt4)
  source 1..1897: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14066 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut1 (opt5)
  source 1..1897: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagaccaactctctgggatcaataacattgctttctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14067 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut1 (opt6)
  source 1..1897: mol_type = other RNA
gggagagcggctcggccattttgtcccagtcagtccggaggctgcggctgcagaagtaccgcctgcggagtaactgcaaagaagcttaccatggaacttccaattctaaaaaccaatgctataacaacaatattagcagcagttacattatgcttcgcctcatcacaaaatatcacagaagaattttaccaatccacatgctcagcagtatctaaagggtacctaggagccctacgaacaggatggtacacatcagtaataacaatagaactctcaaacatcaaagaaaacaaatgcaatggaacagacgctaaagtaaaattaataaaacaagaactagacaaatacaaaaacgccgtcaccgaacttcagttactcatgcaaagcacacctgcagcaggatcaggttcagcaatatgctcaggaatagcagtttgcaaagtattacacctagaaggtgaagtcaacaaaataaaaaacgcacttctaagtactaacaaagctgtagtatcattatcaaacggagtatccgtactaacctttaaagtcctagacctaaaaaactacatagacaaacaactactcccaatactcaataaacaatcctgctcaattcccaacatcgaaacagtaatagaatttcaacaaaaaaacaatcgccttctagaaataacaagagaattttcagtcaacgccggagtaacaacaccagtatcaacatatatgctaacaaacagtgaactattatccttaataaacgacatgccaataacaaatgaccaaaaaaaactaatgtccaataatgtccaaatagtaagacaacaaagctattcaattatgtgtataataaaagaagaagtattagcatacgtagttcaactaccactatatggcgttatagacacaccatgctggaaattacacacaagcccactatgcacaacaaatacaaaagaaggatccaacatttgcttaactagaactgacagaggatggtactgcgacaacgctggatcagtctctttcttcccacaagcagaaacctgtaaagtacaatcaaatagagtcttctgcgacacaatgaactcactaactctcccatctgaagtaaacttatgcaacatcgatatatttaacccaaaatacgattgtaaaataatgacatccaaaacagacgtttcatcaagcgtaatcacctccctcggagcaatcgtaagctgctacggtaaaacaaaatgcacagcatccaacaaaaacagaggcatcataaaaacattctcaaacggatgtgactatgtatcaaacaaaggagtagacacagtttcagtaggcaataccttatactgtgtcaataaacaagaaggacaatcactatatgtaaaaggagaacctataataaacttctacgaccccctcgtcttccctagcgatgaatttgacgcatcaatatcgcaagtaaacgaaaaaataaaccaatcattagcctttataagaaaatcagacgaattattacacaacgtaaacgtggggaaaagcacaactaacatcatgataacaactatcataattgtaatcatcgtcatcctattactcctaatcgcagtaggactattcctatactgcaaagctagatcaacaccagtcaccctatcgaaagatcaattgtcaggaataaacaatatagccttttcaaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14068 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut1 (opt11)
  source 1..1897: mol_type = other RNA
gggagagcggctcggccattttgtcccagtcagtccggaggctgcggctgcagaagtaccgcctgcggagtaactgcaaagaagcttaccatggaactccccatcctcaaaacgaacgccatcacaaccatcctcgccgccgtcaccctctgcttcgcgtcatcccaaaacataactgaagagttctatcaatcaacctgctccgcagtctcaaaaggctacctcggcgccctacggaccggctggtacacaagcgtcatcacaatagaactttccaacatcaaagaaaacaaatgtaacggcaccgacgcaaaagtcaaactcataaaacaagaactagacaaatataaaaacgccgtaactgaactacaactcctcatgcaatcaactcctgcagccggtagcggctccgcaatctgctcaggcatcgcagtctgcaaagtcttacacctagaaggcgaagtcaacaaaatcaagaacgccctactatccacaaacaaagcagtagtctctctatccaacggagtctccgtcctcacattcaaagtactcgacctaaagaactacatcgacaaacaactactaccaatcttaaacaaacaatcctgctcaatccctaacattgaaaccgtcatagagttccaacagaaaaacaaccgcctcctcgaaataaccagagagttctcagtcaacgccggcgtcaccaccccggtctcaacctacatgctaaccaactctgaacttctcagcctaatcaacgacatgcccattaccaacgaccaaaagaaactcatgtccaataacgtccaaatcgttcgacaacaatcctactcaatcatgtgcatcataaaagaagaagtcctagcatacgtcgtccaactcccactatacggcgtaatcgacaccccctgctggaaactccacacctcccctctctgtaccaccaacaccaaagaagggtccaacatctgcctcacgcgcaccgaccgaggctggtattgcgacaatgcaggctctgtctccttcttcccccaagccgaaacctgcaaagtccaatctaaccgcgtcttctgcgacaccatgaacagtcttaccctcccgtcagaagtcaacctctgcaacatagatatcttcaacccaaaatacgactgcaaaatcatgacctcaaaaaccgacgtttcctcatccgttatcacctccctcggcgcaatcgtcagctgctacggcaagacaaagtgcacggcttcaaacaaaaaccgcggaatcatcaagacattcagcaacggctgcgactacgtatccaacaaaggagtggacacagtctccgttggaaacaccctctactgcgtaaacaaacaagaaggccaatcactctacgtcaaaggcgaacccatcatcaacttctacgacccactcgtcttcccctccgacgagttcgacgcctcaatcagccaagtcaacgagaaaattaaccagtcactcgccttcatacgcaaatccgacgaacttctacacaacgtaaacgtcggaaaatcaaccacaaacatcatgattaccacaattatcatagtcatcatagtaatcctcctgctactcatagcagtcggactcttcctatactgcaaagcccgctccacccctgtcaccctatccaaagaccaactttccggcatcaacaacatagccttttccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14069 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut1 (opt1)
  source 1..1906: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14070 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut1 (opt1)
  source 1..1906: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14071 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut1 (opt2)
  source 1..1906: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14072 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut1 (opt3)
  source 1..1906: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagaccaactcagtggcattaataacatcgcattctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14073 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut1 (opt4)
  source 1..1906: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14074 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut1 (opt5)
  source 1..1906: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagaccaactctctgggatcaataacattgctttctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14075 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut1 (opt6)
  source 1..1906: mol_type = other RNA
gggagacccgtgacccggaagttgtacggctacgcgactttccctcccacaaaccctcgcgcccttcctttcctacttgggcccggcagaaagcttaccatggaacttccaattctaaaaaccaatgctataacaacaatattagcagcagttacattatgcttcgcctcatcacaaaatatcacagaagaattttaccaatccacatgctcagcagtatctaaagggtacctaggagccctacgaacaggatggtacacatcagtaataacaatagaactctcaaacatcaaagaaaacaaatgcaatggaacagacgctaaagtaaaattaataaaacaagaactagacaaatacaaaaacgccgtcaccgaacttcagttactcatgcaaagcacacctgcagcaggatcaggttcagcaatatgctcaggaatagcagtttgcaaagtattacacctagaaggtgaagtcaacaaaataaaaaacgcacttctaagtactaacaaagctgtagtatcattatcaaacggagtatccgtactaacctttaaagtcctagacctaaaaaactacatagacaaacaactactcccaatactcaataaacaatcctgctcaattcccaacatcgaaacagtaatagaatttcaacaaaaaaacaatcgccttctagaaataacaagagaattttcagtcaacgccggagtaacaacaccagtatcaacatatatgctaacaaacagtgaactattatccttaataaacgacatgccaataacaaatgaccaaaaaaaactaatgtccaataatgtccaaatagtaagacaacaaagctattcaattatgtgtataataaaagaagaagtattagcatacgtagttcaactaccactatatggcgttatagacacaccatgctggaaattacacacaagcccactatgcacaacaaatacaaaagaaggatccaacatttgcttaactagaactgacagaggatggtactgcgacaacgctggatcagtctctttcttcccacaagcagaaacctgtaaagtacaatcaaatagagtcttctgcgacacaatgaactcactaactctcccatctgaagtaaacttatgcaacatcgatatatttaacccaaaatacgattgtaaaataatgacatccaaaacagacgtttcatcaagcgtaatcacctccctcggagcaatcgtaagctgctacggtaaaacaaaatgcacagcatccaacaaaaacagaggcatcataaaaacattctcaaacggatgtgactatgtatcaaacaaaggagtagacacagtttcagtaggcaataccttatactgtgtcaataaacaagaaggacaatcactatatgtaaaaggagaacctataataaacttctacgaccccctcgtcttccctagcgatgaatttgacgcatcaatatcgcaagtaaacgaaaaaataaaccaatcattagcctttataagaaaatcagacgaattattacacaacgtaaacgtggggaaaagcacaactaacatcatgataacaactatcataattgtaatcatcgtcatcctattactcctaatcgcagtaggactattcctatactgcaaagctagatcaacaccagtcaccctatcgaaagatcaattgtcaggaataaacaatatagccttttcaaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14076 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut1 (opt11)
  source 1..1906: mol_type = other RNA
gggagacccgtgacccggaagttgtacggctacgcgactttccctcccacaaaccctcgcgcccttcctttcctacttgggcccggcagaaagcttaccatggaactccccatcctcaaaacgaacgccatcacaaccatcctcgccgccgtcaccctctgcttcgcgtcatcccaaaacataactgaagagttctatcaatcaacctgctccgcagtctcaaaaggctacctcggcgccctacggaccggctggtacacaagcgtcatcacaatagaactttccaacatcaaagaaaacaaatgtaacggcaccgacgcaaaagtcaaactcataaaacaagaactagacaaatataaaaacgccgtaactgaactacaactcctcatgcaatcaactcctgcagccggtagcggctccgcaatctgctcaggcatcgcagtctgcaaagtcttacacctagaaggcgaagtcaacaaaatcaagaacgccctactatccacaaacaaagcagtagtctctctatccaacggagtctccgtcctcacattcaaagtactcgacctaaagaactacatcgacaaacaactactaccaatcttaaacaaacaatcctgctcaatccctaacattgaaaccgtcatagagttccaacagaaaaacaaccgcctcctcgaaataaccagagagttctcagtcaacgccggcgtcaccaccccggtctcaacctacatgctaaccaactctgaacttctcagcctaatcaacgacatgcccattaccaacgaccaaaagaaactcatgtccaataacgtccaaatcgttcgacaacaatcctactcaatcatgtgcatcataaaagaagaagtcctagcatacgtcgtccaactcccactatacggcgtaatcgacaccccctgctggaaactccacacctcccctctctgtaccaccaacaccaaagaagggtccaacatctgcctcacgcgcaccgaccgaggctggtattgcgacaatgcaggctctgtctccttcttcccccaagccgaaacctgcaaagtccaatctaaccgcgtcttctgcgacaccatgaacagtcttaccctcccgtcagaagtcaacctctgcaacatagatatcttcaacccaaaatacgactgcaaaatcatgacctcaaaaaccgacgtttcctcatccgttatcacctccctcggcgcaatcgtcagctgctacggcaagacaaagtgcacggcttcaaacaaaaaccgcggaatcatcaagacattcagcaacggctgcgactacgtatccaacaaaggagtggacacagtctccgttggaaacaccctctactgcgtaaacaaacaagaaggccaatcactctacgtcaaaggcgaacccatcatcaacttctacgacccactcgtcttcccctccgacgagttcgacgcctcaatcagccaagtcaacgagaaaattaaccagtcactcgccttcatacgcaaatccgacgaacttctacacaacgtaaacgtcggaaaatcaaccacaaacatcatgattaccacaattatcatagtcatcatagtaatcctcctgctactcatagcagtcggactcttcctatactgcaaagcccgctccacccctgtcaccctatccaaagaccaactttccggcatcaacaacatagccttttccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14077 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut1 (opt1)
  source 1..1961: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14078 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut1 (opt1)
  source 1..1961: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14079 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut1 (opt2)
  source 1..1961: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14080 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut1 (opt3)
  source 1..1961: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagaccaactcagtggcattaataacatcgcattctctaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14081 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut1 (opt4)
  source 1..1961: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14082 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut1 (opt5)
  source 1..1961: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagaccaactctctgggatcaataacattgctttctccaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14083 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut1 (opt6)
  source 1..1961: mol_type = other RNA
gggagagcggctcggccattttgtcccagtcagtccggaggctgcggctgcagaagtaccgcctgcggagtaactgcaaagaagcttaccatggaacttccaattctaaaaaccaatgctataacaacaatattagcagcagttacattatgcttcgcctcatcacaaaatatcacagaagaattttaccaatccacatgctcagcagtatctaaagggtacctaggagccctacgaacaggatggtacacatcagtaataacaatagaactctcaaacatcaaagaaaacaaatgcaatggaacagacgctaaagtaaaattaataaaacaagaactagacaaatacaaaaacgccgtcaccgaacttcagttactcatgcaaagcacacctgcagcaggatcaggttcagcaatatgctcaggaatagcagtttgcaaagtattacacctagaaggtgaagtcaacaaaataaaaaacgcacttctaagtactaacaaagctgtagtatcattatcaaacggagtatccgtactaacctttaaagtcctagacctaaaaaactacatagacaaacaactactcccaatactcaataaacaatcctgctcaattcccaacatcgaaacagtaatagaatttcaacaaaaaaacaatcgccttctagaaataacaagagaattttcagtcaacgccggagtaacaacaccagtatcaacatatatgctaacaaacagtgaactattatccttaataaacgacatgccaataacaaatgaccaaaaaaaactaatgtccaataatgtccaaatagtaagacaacaaagctattcaattatgtgtataataaaagaagaagtattagcatacgtagttcaactaccactatatggcgttatagacacaccatgctggaaattacacacaagcccactatgcacaacaaatacaaaagaaggatccaacatttgcttaactagaactgacagaggatggtactgcgacaacgctggatcagtctctttcttcccacaagcagaaacctgtaaagtacaatcaaatagagtcttctgcgacacaatgaactcactaactctcccatctgaagtaaacttatgcaacatcgatatatttaacccaaaatacgattgtaaaataatgacatccaaaacagacgtttcatcaagcgtaatcacctccctcggagcaatcgtaagctgctacggtaaaacaaaatgcacagcatccaacaaaaacagaggcatcataaaaacattctcaaacggatgtgactatgtatcaaacaaaggagtagacacagtttcagtaggcaataccttatactgtgtcaataaacaagaaggacaatcactatatgtaaaaggagaacctataataaacttctacgaccccctcgtcttccctagcgatgaatttgacgcatcaatatcgcaagtaaacgaaaaaataaaccaatcattagcctttataagaaaatcagacgaattattacacaacgtaaacgtggggaaaagcacaactaacatcatgataacaactatcataattgtaatcatcgtcatcctattactcctaatcgcagtaggactattcctatactgcaaagctagatcaacaccagtcaccctatcgaaagatcaattgtcaggaataaacaatatagccttttcaaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14084 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut1 (opt11)
  source 1..1961: mol_type = other RNA
gggagagcggctcggccattttgtcccagtcagtccggaggctgcggctgcagaagtaccgcctgcggagtaactgcaaagaagcttaccatggaactccccatcctcaaaacgaacgccatcacaaccatcctcgccgccgtcaccctctgcttcgcgtcatcccaaaacataactgaagagttctatcaatcaacctgctccgcagtctcaaaaggctacctcggcgccctacggaccggctggtacacaagcgtcatcacaatagaactttccaacatcaaagaaaacaaatgtaacggcaccgacgcaaaagtcaaactcataaaacaagaactagacaaatataaaaacgccgtaactgaactacaactcctcatgcaatcaactcctgcagccggtagcggctccgcaatctgctcaggcatcgcagtctgcaaagtcttacacctagaaggcgaagtcaacaaaatcaagaacgccctactatccacaaacaaagcagtagtctctctatccaacggagtctccgtcctcacattcaaagtactcgacctaaagaactacatcgacaaacaactactaccaatcttaaacaaacaatcctgctcaatccctaacattgaaaccgtcatagagttccaacagaaaaacaaccgcctcctcgaaataaccagagagttctcagtcaacgccggcgtcaccaccccggtctcaacctacatgctaaccaactctgaacttctcagcctaatcaacgacatgcccattaccaacgaccaaaagaaactcatgtccaataacgtccaaatcgttcgacaacaatcctactcaatcatgtgcatcataaaagaagaagtcctagcatacgtcgtccaactcccactatacggcgtaatcgacaccccctgctggaaactccacacctcccctctctgtaccaccaacaccaaagaagggtccaacatctgcctcacgcgcaccgaccgaggctggtattgcgacaatgcaggctctgtctccttcttcccccaagccgaaacctgcaaagtccaatctaaccgcgtcttctgcgacaccatgaacagtcttaccctcccgtcagaagtcaacctctgcaacatagatatcttcaacccaaaatacgactgcaaaatcatgacctcaaaaaccgacgtttcctcatccgttatcacctccctcggcgcaatcgtcagctgctacggcaagacaaagtgcacggcttcaaacaaaaaccgcggaatcatcaagacattcagcaacggctgcgactacgtatccaacaaaggagtggacacagtctccgttggaaacaccctctactgcgtaaacaaacaagaaggccaatcactctacgtcaaaggcgaacccatcatcaacttctacgacccactcgtcttcccctccgacgagttcgacgcctcaatcagccaagtcaacgagaaaattaaccagtcactcgccttcatacgcaaatccgacgaacttctacacaacgtaaacgtcggaaaatcaaccacaaacatcatgattaccacaattatcatagtcatcatagtaatcctcctgctactcatagcagtcggactcttcctatactgcaaagcccgctccacccctgtcaccctatccaaagaccaactttccggcatcaacaacatagccttttccaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14085 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut1 (opt1)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14086 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut1 (opt1)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14087 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut1 (opt2)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14088 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut1 (opt3)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagaccaactcagtggcattaataacatcgcattctctaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14089 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut1 (opt4)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14090 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut1 (opt5)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagaccaactctctgggatcaataacattgctttctccaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14091 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut1 (opt6)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttccaattctaaaaaccaatgctataacaacaatattagcagcagttacattatgcttcgcctcatcacaaaatatcacagaagaattttaccaatccacatgctcagcagtatctaaagggtacctaggagccctacgaacaggatggtacacatcagtaataacaatagaactctcaaacatcaaagaaaacaaatgcaatggaacagacgctaaagtaaaattaataaaacaagaactagacaaatacaaaaacgccgtcaccgaacttcagttactcatgcaaagcacacctgcagcaggatcaggttcagcaatatgctcaggaatagcagtttgcaaagtattacacctagaaggtgaagtcaacaaaataaaaaacgcacttctaagtactaacaaagctgtagtatcattatcaaacggagtatccgtactaacctttaaagtcctagacctaaaaaactacatagacaaacaactactcccaatactcaataaacaatcctgctcaattcccaacatcgaaacagtaatagaatttcaacaaaaaaacaatcgccttctagaaataacaagagaattttcagtcaacgccggagtaacaacaccagtatcaacatatatgctaacaaacagtgaactattatccttaataaacgacatgccaataacaaatgaccaaaaaaaactaatgtccaataatgtccaaatagtaagacaacaaagctattcaattatgtgtataataaaagaagaagtattagcatacgtagttcaactaccactatatggcgttatagacacaccatgctggaaattacacacaagcccactatgcacaacaaatacaaaagaaggatccaacatttgcttaactagaactgacagaggatggtactgcgacaacgctggatcagtctctttcttcccacaagcagaaacctgtaaagtacaatcaaatagagtcttctgcgacacaatgaactcactaactctcccatctgaagtaaacttatgcaacatcgatatatttaacccaaaatacgattgtaaaataatgacatccaaaacagacgtttcatcaagcgtaatcacctccctcggagcaatcgtaagctgctacggtaaaacaaaatgcacagcatccaacaaaaacagaggcatcataaaaacattctcaaacggatgtgactatgtatcaaacaaaggagtagacacagtttcagtaggcaataccttatactgtgtcaataaacaagaaggacaatcactatatgtaaaaggagaacctataataaacttctacgaccccctcgtcttccctagcgatgaatttgacgcatcaatatcgcaagtaaacgaaaaaataaaccaatcattagcctttataagaaaatcagacgaattattacacaacgtaaacgtggggaaaagcacaactaacatcatgataacaactatcataattgtaatcatcgtcatcctattactcctaatcgcagtaggactattcctatactgcaaagctagatcaacaccagtcaccctatcgaaagatcaattgtcaggaataaacaatatagccttttcaaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14092 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut1 (opt11)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatcctcaaaacgaacgccatcacaaccatcctcgccgccgtcaccctctgcttcgcgtcatcccaaaacataactgaagagttctatcaatcaacctgctccgcagtctcaaaaggctacctcggcgccctacggaccggctggtacacaagcgtcatcacaatagaactttccaacatcaaagaaaacaaatgtaacggcaccgacgcaaaagtcaaactcataaaacaagaactagacaaatataaaaacgccgtaactgaactacaactcctcatgcaatcaactcctgcagccggtagcggctccgcaatctgctcaggcatcgcagtctgcaaagtcttacacctagaaggcgaagtcaacaaaatcaagaacgccctactatccacaaacaaagcagtagtctctctatccaacggagtctccgtcctcacattcaaagtactcgacctaaagaactacatcgacaaacaactactaccaatcttaaacaaacaatcctgctcaatccctaacattgaaaccgtcatagagttccaacagaaaaacaaccgcctcctcgaaataaccagagagttctcagtcaacgccggcgtcaccaccccggtctcaacctacatgctaaccaactctgaacttctcagcctaatcaacgacatgcccattaccaacgaccaaaagaaactcatgtccaataacgtccaaatcgttcgacaacaatcctactcaatcatgtgcatcataaaagaagaagtcctagcatacgtcgtccaactcccactatacggcgtaatcgacaccccctgctggaaactccacacctcccctctctgtaccaccaacaccaaagaagggtccaacatctgcctcacgcgcaccgaccgaggctggtattgcgacaatgcaggctctgtctccttcttcccccaagccgaaacctgcaaagtccaatctaaccgcgtcttctgcgacaccatgaacagtcttaccctcccgtcagaagtcaacctctgcaacatagatatcttcaacccaaaatacgactgcaaaatcatgacctcaaaaaccgacgtttcctcatccgttatcacctccctcggcgcaatcgtcagctgctacggcaagacaaagtgcacggcttcaaacaaaaaccgcggaatcatcaagacattcagcaacggctgcgactacgtatccaacaaaggagtggacacagtctccgttggaaacaccctctactgcgtaaacaaacaagaaggccaatcactctacgtcaaaggcgaacccatcatcaacttctacgacccactcgtcttcccctccgacgagttcgacgcctcaatcagccaagtcaacgagaaaattaaccagtcactcgccttcatacgcaaatccgacgaacttctacacaacgtaaacgtcggaaaatcaaccacaaacatcatgattaccacaattatcatagtcatcatagtaatcctcctgctactcatagcagtcggactcttcctatactgcaaagcccgctccacccctgtcaccctatccaaagaccaactttccggcatcaacaacatagccttttccaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14093 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut1 (opt1)
  source 1..1960: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14094 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut1 (opt1)
  source 1..1960: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14095 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut1 (opt2)
  source 1..1960: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14096 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut1 (opt3)
  source 1..1960: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagaccaactcagtggcattaataacatcgcattctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14097 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut1 (opt4)
  source 1..1960: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14098 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut1 (opt5)
  source 1..1960: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagaccaactctctgggatcaataacattgctttctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14099 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut1 (opt6)
  source 1..1960: mol_type = other RNA
gggagagtcccgcagtcggcgtccagcggctctgcttgttcgtgtgtgtgtcgttgcaggccttattcaagcttaccatggaacttccaattctaaaaaccaatgctataacaacaatattagcagcagttacattatgcttcgcctcatcacaaaatatcacagaagaattttaccaatccacatgctcagcagtatctaaagggtacctaggagccctacgaacaggatggtacacatcagtaataacaatagaactctcaaacatcaaagaaaacaaatgcaatggaacagacgctaaagtaaaattaataaaacaagaactagacaaatacaaaaacgccgtcaccgaacttcagttactcatgcaaagcacacctgcagcaggatcaggttcagcaatatgctcaggaatagcagtttgcaaagtattacacctagaaggtgaagtcaacaaaataaaaaacgcacttctaagtactaacaaagctgtagtatcattatcaaacggagtatccgtactaacctttaaagtcctagacctaaaaaactacatagacaaacaactactcccaatactcaataaacaatcctgctcaattcccaacatcgaaacagtaatagaatttcaacaaaaaaacaatcgccttctagaaataacaagagaattttcagtcaacgccggagtaacaacaccagtatcaacatatatgctaacaaacagtgaactattatccttaataaacgacatgccaataacaaatgaccaaaaaaaactaatgtccaataatgtccaaatagtaagacaacaaagctattcaattatgtgtataataaaagaagaagtattagcatacgtagttcaactaccactatatggcgttatagacacaccatgctggaaattacacacaagcccactatgcacaacaaatacaaaagaaggatccaacatttgcttaactagaactgacagaggatggtactgcgacaacgctggatcagtctctttcttcccacaagcagaaacctgtaaagtacaatcaaatagagtcttctgcgacacaatgaactcactaactctcccatctgaagtaaacttatgcaacatcgatatatttaacccaaaatacgattgtaaaataatgacatccaaaacagacgtttcatcaagcgtaatcacctccctcggagcaatcgtaagctgctacggtaaaacaaaatgcacagcatccaacaaaaacagaggcatcataaaaacattctcaaacggatgtgactatgtatcaaacaaaggagtagacacagtttcagtaggcaataccttatactgtgtcaataaacaagaaggacaatcactatatgtaaaaggagaacctataataaacttctacgaccccctcgtcttccctagcgatgaatttgacgcatcaatatcgcaagtaaacgaaaaaataaaccaatcattagcctttataagaaaatcagacgaattattacacaacgtaaacgtggggaaaagcacaactaacatcatgataacaactatcataattgtaatcatcgtcatcctattactcctaatcgcagtaggactattcctatactgcaaagctagatcaacaccagtcaccctatcgaaagatcaattgtcaggaataaacaatatagccttttcaaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14100 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut1 (opt11)
  source 1..1960: mol_type = other RNA
gggagagtcccgcagtcggcgtccagcggctctgcttgttcgtgtgtgtgtcgttgcaggccttattcaagcttaccatggaactccccatcctcaaaacgaacgccatcacaaccatcctcgccgccgtcaccctctgcttcgcgtcatcccaaaacataactgaagagttctatcaatcaacctgctccgcagtctcaaaaggctacctcggcgccctacggaccggctggtacacaagcgtcatcacaatagaactttccaacatcaaagaaaacaaatgtaacggcaccgacgcaaaagtcaaactcataaaacaagaactagacaaatataaaaacgccgtaactgaactacaactcctcatgcaatcaactcctgcagccggtagcggctccgcaatctgctcaggcatcgcagtctgcaaagtcttacacctagaaggcgaagtcaacaaaatcaagaacgccctactatccacaaacaaagcagtagtctctctatccaacggagtctccgtcctcacattcaaagtactcgacctaaagaactacatcgacaaacaactactaccaatcttaaacaaacaatcctgctcaatccctaacattgaaaccgtcatagagttccaacagaaaaacaaccgcctcctcgaaataaccagagagttctcagtcaacgccggcgtcaccaccccggtctcaacctacatgctaaccaactctgaacttctcagcctaatcaacgacatgcccattaccaacgaccaaaagaaactcatgtccaataacgtccaaatcgttcgacaacaatcctactcaatcatgtgcatcataaaagaagaagtcctagcatacgtcgtccaactcccactatacggcgtaatcgacaccccctgctggaaactccacacctcccctctctgtaccaccaacaccaaagaagggtccaacatctgcctcacgcgcaccgaccgaggctggtattgcgacaatgcaggctctgtctccttcttcccccaagccgaaacctgcaaagtccaatctaaccgcgtcttctgcgacaccatgaacagtcttaccctcccgtcagaagtcaacctctgcaacatagatatcttcaacccaaaatacgactgcaaaatcatgacctcaaaaaccgacgtttcctcatccgttatcacctccctcggcgcaatcgtcagctgctacggcaagacaaagtgcacggcttcaaacaaaaaccgcggaatcatcaagacattcagcaacggctgcgactacgtatccaacaaaggagtggacacagtctccgttggaaacaccctctactgcgtaaacaaacaagaaggccaatcactctacgtcaaaggcgaacccatcatcaacttctacgacccactcgtcttcccctccgacgagttcgacgcctcaatcagccaagtcaacgagaaaattaaccagtcactcgccttcatacgcaaatccgacgaacttctacacaacgtaaacgtcggaaaatcaaccacaaacatcatgattaccacaattatcatagtcatcatagtaatcctcctgctactcatagcagtcggactcttcctatactgcaaagcccgctccacccctgtcaccctatccaaagaccaactttccggcatcaacaacatagccttttccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14101 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut1 (opt1)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14102 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut1 (opt1)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14103 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut1 (opt2)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14104 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut1 (opt3)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagaccaactcagtggcattaataacatcgcattctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14105 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut1 (opt4)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14106 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut1 (opt5)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagaccaactctctgggatcaataacattgctttctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14107 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut1 (opt6)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttccaattctaaaaaccaatgctataacaacaatattagcagcagttacattatgcttcgcctcatcacaaaatatcacagaagaattttaccaatccacatgctcagcagtatctaaagggtacctaggagccctacgaacaggatggtacacatcagtaataacaatagaactctcaaacatcaaagaaaacaaatgcaatggaacagacgctaaagtaaaattaataaaacaagaactagacaaatacaaaaacgccgtcaccgaacttcagttactcatgcaaagcacacctgcagcaggatcaggttcagcaatatgctcaggaatagcagtttgcaaagtattacacctagaaggtgaagtcaacaaaataaaaaacgcacttctaagtactaacaaagctgtagtatcattatcaaacggagtatccgtactaacctttaaagtcctagacctaaaaaactacatagacaaacaactactcccaatactcaataaacaatcctgctcaattcccaacatcgaaacagtaatagaatttcaacaaaaaaacaatcgccttctagaaataacaagagaattttcagtcaacgccggagtaacaacaccagtatcaacatatatgctaacaaacagtgaactattatccttaataaacgacatgccaataacaaatgaccaaaaaaaactaatgtccaataatgtccaaatagtaagacaacaaagctattcaattatgtgtataataaaagaagaagtattagcatacgtagttcaactaccactatatggcgttatagacacaccatgctggaaattacacacaagcccactatgcacaacaaatacaaaagaaggatccaacatttgcttaactagaactgacagaggatggtactgcgacaacgctggatcagtctctttcttcccacaagcagaaacctgtaaagtacaatcaaatagagtcttctgcgacacaatgaactcactaactctcccatctgaagtaaacttatgcaacatcgatatatttaacccaaaatacgattgtaaaataatgacatccaaaacagacgtttcatcaagcgtaatcacctccctcggagcaatcgtaagctgctacggtaaaacaaaatgcacagcatccaacaaaaacagaggcatcataaaaacattctcaaacggatgtgactatgtatcaaacaaaggagtagacacagtttcagtaggcaataccttatactgtgtcaataaacaagaaggacaatcactatatgtaaaaggagaacctataataaacttctacgaccccctcgtcttccctagcgatgaatttgacgcatcaatatcgcaagtaaacgaaaaaataaaccaatcattagcctttataagaaaatcagacgaattattacacaacgtaaacgtggggaaaagcacaactaacatcatgataacaactatcataattgtaatcatcgtcatcctattactcctaatcgcagtaggactattcctatactgcaaagctagatcaacaccagtcaccctatcgaaagatcaattgtcaggaataaacaatatagccttttcaaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14108 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut1 (opt11)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatcctcaaaacgaacgccatcacaaccatcctcgccgccgtcaccctctgcttcgcgtcatcccaaaacataactgaagagttctatcaatcaacctgctccgcagtctcaaaaggctacctcggcgccctacggaccggctggtacacaagcgtcatcacaatagaactttccaacatcaaagaaaacaaatgtaacggcaccgacgcaaaagtcaaactcataaaacaagaactagacaaatataaaaacgccgtaactgaactacaactcctcatgcaatcaactcctgcagccggtagcggctccgcaatctgctcaggcatcgcagtctgcaaagtcttacacctagaaggcgaagtcaacaaaatcaagaacgccctactatccacaaacaaagcagtagtctctctatccaacggagtctccgtcctcacattcaaagtactcgacctaaagaactacatcgacaaacaactactaccaatcttaaacaaacaatcctgctcaatccctaacattgaaaccgtcatagagttccaacagaaaaacaaccgcctcctcgaaataaccagagagttctcagtcaacgccggcgtcaccaccccggtctcaacctacatgctaaccaactctgaacttctcagcctaatcaacgacatgcccattaccaacgaccaaaagaaactcatgtccaataacgtccaaatcgttcgacaacaatcctactcaatcatgtgcatcataaaagaagaagtcctagcatacgtcgtccaactcccactatacggcgtaatcgacaccccctgctggaaactccacacctcccctctctgtaccaccaacaccaaagaagggtccaacatctgcctcacgcgcaccgaccgaggctggtattgcgacaatgcaggctctgtctccttcttcccccaagccgaaacctgcaaagtccaatctaaccgcgtcttctgcgacaccatgaacagtcttaccctcccgtcagaagtcaacctctgcaacatagatatcttcaacccaaaatacgactgcaaaatcatgacctcaaaaaccgacgtttcctcatccgttatcacctccctcggcgcaatcgtcagctgctacggcaagacaaagtgcacggcttcaaacaaaaaccgcggaatcatcaagacattcagcaacggctgcgactacgtatccaacaaaggagtggacacagtctccgttggaaacaccctctactgcgtaaacaaacaagaaggccaatcactctacgtcaaaggcgaacccatcatcaacttctacgacccactcgtcttcccctccgacgagttcgacgcctcaatcagccaagtcaacgagaaaattaaccagtcactcgccttcatacgcaaatccgacgaacttctacacaacgtaaacgtcggaaaatcaaccacaaacatcatgattaccacaattatcatagtcatcatagtaatcctcctgctactcatagcagtcggactcttcctatactgcaaagcccgctccacccctgtcaccctatccaaagaccaactttccggcatcaacaacatagccttttccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14109 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut1 (opt1)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14110 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut1 (opt1)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14111 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut1 (opt2)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14112 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut1 (opt3)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagaccaactcagtggcattaataacatcgcattctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14113 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut1 (opt4)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14114 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut1 (opt5)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagaccaactctctgggatcaataacattgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14115 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut1 (opt6)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaacttccaattctaaaaaccaatgctataacaacaatattagcagcagttacattatgcttcgcctcatcacaaaatatcacagaagaattttaccaatccacatgctcagcagtatctaaagggtacctaggagccctacgaacaggatggtacacatcagtaataacaatagaactctcaaacatcaaagaaaacaaatgcaatggaacagacgctaaagtaaaattaataaaacaagaactagacaaatacaaaaacgccgtcaccgaacttcagttactcatgcaaagcacacctgcagcaggatcaggttcagcaatatgctcaggaatagcagtttgcaaagtattacacctagaaggtgaagtcaacaaaataaaaaacgcacttctaagtactaacaaagctgtagtatcattatcaaacggagtatccgtactaacctttaaagtcctagacctaaaaaactacatagacaaacaactactcccaatactcaataaacaatcctgctcaattcccaacatcgaaacagtaatagaatttcaacaaaaaaacaatcgccttctagaaataacaagagaattttcagtcaacgccggagtaacaacaccagtatcaacatatatgctaacaaacagtgaactattatccttaataaacgacatgccaataacaaatgaccaaaaaaaactaatgtccaataatgtccaaatagtaagacaacaaagctattcaattatgtgtataataaaagaagaagtattagcatacgtagttcaactaccactatatggcgttatagacacaccatgctggaaattacacacaagcccactatgcacaacaaatacaaaagaaggatccaacatttgcttaactagaactgacagaggatggtactgcgacaacgctggatcagtctctttcttcccacaagcagaaacctgtaaagtacaatcaaatagagtcttctgcgacacaatgaactcactaactctcccatctgaagtaaacttatgcaacatcgatatatttaacccaaaatacgattgtaaaataatgacatccaaaacagacgtttcatcaagcgtaatcacctccctcggagcaatcgtaagctgctacggtaaaacaaaatgcacagcatccaacaaaaacagaggcatcataaaaacattctcaaacggatgtgactatgtatcaaacaaaggagtagacacagtttcagtaggcaataccttatactgtgtcaataaacaagaaggacaatcactatatgtaaaaggagaacctataataaacttctacgaccccctcgtcttccctagcgatgaatttgacgcatcaatatcgcaagtaaacgaaaaaataaaccaatcattagcctttataagaaaatcagacgaattattacacaacgtaaacgtggggaaaagcacaactaacatcatgataacaactatcataattgtaatcatcgtcatcctattactcctaatcgcagtaggactattcctatactgcaaagctagatcaacaccagtcaccctatcgaaagatcaattgtcaggaataaacaatatagccttttcaaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14116 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut1 (opt11)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactccccatcctcaaaacgaacgccatcacaaccatcctcgccgccgtcaccctctgcttcgcgtcatcccaaaacataactgaagagttctatcaatcaacctgctccgcagtctcaaaaggctacctcggcgccctacggaccggctggtacacaagcgtcatcacaatagaactttccaacatcaaagaaaacaaatgtaacggcaccgacgcaaaagtcaaactcataaaacaagaactagacaaatataaaaacgccgtaactgaactacaactcctcatgcaatcaactcctgcagccggtagcggctccgcaatctgctcaggcatcgcagtctgcaaagtcttacacctagaaggcgaagtcaacaaaatcaagaacgccctactatccacaaacaaagcagtagtctctctatccaacggagtctccgtcctcacattcaaagtactcgacctaaagaactacatcgacaaacaactactaccaatcttaaacaaacaatcctgctcaatccctaacattgaaaccgtcatagagttccaacagaaaaacaaccgcctcctcgaaataaccagagagttctcagtcaacgccggcgtcaccaccccggtctcaacctacatgctaaccaactctgaacttctcagcctaatcaacgacatgcccattaccaacgaccaaaagaaactcatgtccaataacgtccaaatcgttcgacaacaatcctactcaatcatgtgcatcataaaagaagaagtcctagcatacgtcgtccaactcccactatacggcgtaatcgacaccccctgctggaaactccacacctcccctctctgtaccaccaacaccaaagaagggtccaacatctgcctcacgcgcaccgaccgaggctggtattgcgacaatgcaggctctgtctccttcttcccccaagccgaaacctgcaaagtccaatctaaccgcgtcttctgcgacaccatgaacagtcttaccctcccgtcagaagtcaacctctgcaacatagatatcttcaacccaaaatacgactgcaaaatcatgacctcaaaaaccgacgtttcctcatccgttatcacctccctcggcgcaatcgtcagctgctacggcaagacaaagtgcacggcttcaaacaaaaaccgcggaatcatcaagacattcagcaacggctgcgactacgtatccaacaaaggagtggacacagtctccgttggaaacaccctctactgcgtaaacaaacaagaaggccaatcactctacgtcaaaggcgaacccatcatcaacttctacgacccactcgtcttcccctccgacgagttcgacgcctcaatcagccaagtcaacgagaaaattaaccagtcactcgccttcatacgcaaatccgacgaacttctacacaacgtaaacgtcggaaaatcaaccacaaacatcatgattaccacaattatcatagtcatcatagtaatcctcctgctactcatagcagtcggactcttcctatactgcaaagcccgctccacccctgtcaccctatccaaagaccaactttccggcatcaacaacatagccttttccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14117 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut1 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14118 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut1 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14119 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut1 (opt2)
  source 1..1919: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14120 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut1 (opt3)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagaccaactcagtggcattaataacatcgcattctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14121 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut1 (opt4)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14122 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut1 (opt5)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagaccaactctctgggatcaataacattgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14123 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut1 (opt6)
  source 1..1919: mol_type = other RNA
gggagacccgtgacccggaagttgtacggctacgcgactttccctcccacaaaccctcgcgcccttcctttcctacttgggcccggcagaaagcttaccatggaacttccaattctaaaaaccaatgctataacaacaatattagcagcagttacattatgcttcgcctcatcacaaaatatcacagaagaattttaccaatccacatgctcagcagtatctaaagggtacctaggagccctacgaacaggatggtacacatcagtaataacaatagaactctcaaacatcaaagaaaacaaatgcaatggaacagacgctaaagtaaaattaataaaacaagaactagacaaatacaaaaacgccgtcaccgaacttcagttactcatgcaaagcacacctgcagcaggatcaggttcagcaatatgctcaggaatagcagtttgcaaagtattacacctagaaggtgaagtcaacaaaataaaaaacgcacttctaagtactaacaaagctgtagtatcattatcaaacggagtatccgtactaacctttaaagtcctagacctaaaaaactacatagacaaacaactactcccaatactcaataaacaatcctgctcaattcccaacatcgaaacagtaatagaatttcaacaaaaaaacaatcgccttctagaaataacaagagaattttcagtcaacgccggagtaacaacaccagtatcaacatatatgctaacaaacagtgaactattatccttaataaacgacatgccaataacaaatgaccaaaaaaaactaatgtccaataatgtccaaatagtaagacaacaaagctattcaattatgtgtataataaaagaagaagtattagcatacgtagttcaactaccactatatggcgttatagacacaccatgctggaaattacacacaagcccactatgcacaacaaatacaaaagaaggatccaacatttgcttaactagaactgacagaggatggtactgcgacaacgctggatcagtctctttcttcccacaagcagaaacctgtaaagtacaatcaaatagagtcttctgcgacacaatgaactcactaactctcccatctgaagtaaacttatgcaacatcgatatatttaacccaaaatacgattgtaaaataatgacatccaaaacagacgtttcatcaagcgtaatcacctccctcggagcaatcgtaagctgctacggtaaaacaaaatgcacagcatccaacaaaaacagaggcatcataaaaacattctcaaacggatgtgactatgtatcaaacaaaggagtagacacagtttcagtaggcaataccttatactgtgtcaataaacaagaaggacaatcactatatgtaaaaggagaacctataataaacttctacgaccccctcgtcttccctagcgatgaatttgacgcatcaatatcgcaagtaaacgaaaaaataaaccaatcattagcctttataagaaaatcagacgaattattacacaacgtaaacgtggggaaaagcacaactaacatcatgataacaactatcataattgtaatcatcgtcatcctattactcctaatcgcagtaggactattcctatactgcaaagctagatcaacaccagtcaccctatcgaaagatcaattgtcaggaataaacaatatagccttttcaaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14124 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut1 (opt11)
  source 1..1919: mol_type = other RNA
gggagacccgtgacccggaagttgtacggctacgcgactttccctcccacaaaccctcgcgcccttcctttcctacttgggcccggcagaaagcttaccatggaactccccatcctcaaaacgaacgccatcacaaccatcctcgccgccgtcaccctctgcttcgcgtcatcccaaaacataactgaagagttctatcaatcaacctgctccgcagtctcaaaaggctacctcggcgccctacggaccggctggtacacaagcgtcatcacaatagaactttccaacatcaaagaaaacaaatgtaacggcaccgacgcaaaagtcaaactcataaaacaagaactagacaaatataaaaacgccgtaactgaactacaactcctcatgcaatcaactcctgcagccggtagcggctccgcaatctgctcaggcatcgcagtctgcaaagtcttacacctagaaggcgaagtcaacaaaatcaagaacgccctactatccacaaacaaagcagtagtctctctatccaacggagtctccgtcctcacattcaaagtactcgacctaaagaactacatcgacaaacaactactaccaatcttaaacaaacaatcctgctcaatccctaacattgaaaccgtcatagagttccaacagaaaaacaaccgcctcctcgaaataaccagagagttctcagtcaacgccggcgtcaccaccccggtctcaacctacatgctaaccaactctgaacttctcagcctaatcaacgacatgcccattaccaacgaccaaaagaaactcatgtccaataacgtccaaatcgttcgacaacaatcctactcaatcatgtgcatcataaaagaagaagtcctagcatacgtcgtccaactcccactatacggcgtaatcgacaccccctgctggaaactccacacctcccctctctgtaccaccaacaccaaagaagggtccaacatctgcctcacgcgcaccgaccgaggctggtattgcgacaatgcaggctctgtctccttcttcccccaagccgaaacctgcaaagtccaatctaaccgcgtcttctgcgacaccatgaacagtcttaccctcccgtcagaagtcaacctctgcaacatagatatcttcaacccaaaatacgactgcaaaatcatgacctcaaaaaccgacgtttcctcatccgttatcacctccctcggcgcaatcgtcagctgctacggcaagacaaagtgcacggcttcaaacaaaaaccgcggaatcatcaagacattcagcaacggctgcgactacgtatccaacaaaggagtggacacagtctccgttggaaacaccctctactgcgtaaacaaacaagaaggccaatcactctacgtcaaaggcgaacccatcatcaacttctacgacccactcgtcttcccctccgacgagttcgacgcctcaatcagccaagtcaacgagaaaattaaccagtcactcgccttcatacgcaaatccgacgaacttctacacaacgtaaacgtcggaaaatcaaccacaaacatcatgattaccacaattatcatagtcatcatagtaatcctcctgctactcatagcagtcggactcttcctatactgcaaagcccgctccacccctgtcaccctatccaaagaccaactttccggcatcaacaacatagccttttccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14125 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut1 (opt1)
  source 1..1889: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14126 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut1 (opt1)
  source 1..1889: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14127 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut1 (opt2)
  source 1..1889: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14128 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut1 (opt3)
  source 1..1889: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagaccaactcagtggcattaataacatcgcattctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14129 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut1 (opt4)
  source 1..1889: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14130 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut1 (opt5)
  source 1..1889: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagaccaactctctgggatcaataacattgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14131 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut1 (opt6)
  source 1..1889: mol_type = other RNA
gggagactttcccattctgtagcagaatttggtgttgcctgtggtcttggtcccgcggagaagcttaccatggaacttccaattctaaaaaccaatgctataacaacaatattagcagcagttacattatgcttcgcctcatcacaaaatatcacagaagaattttaccaatccacatgctcagcagtatctaaagggtacctaggagccctacgaacaggatggtacacatcagtaataacaatagaactctcaaacatcaaagaaaacaaatgcaatggaacagacgctaaagtaaaattaataaaacaagaactagacaaatacaaaaacgccgtcaccgaacttcagttactcatgcaaagcacacctgcagcaggatcaggttcagcaatatgctcaggaatagcagtttgcaaagtattacacctagaaggtgaagtcaacaaaataaaaaacgcacttctaagtactaacaaagctgtagtatcattatcaaacggagtatccgtactaacctttaaagtcctagacctaaaaaactacatagacaaacaactactcccaatactcaataaacaatcctgctcaattcccaacatcgaaacagtaatagaatttcaacaaaaaaacaatcgccttctagaaataacaagagaattttcagtcaacgccggagtaacaacaccagtatcaacatatatgctaacaaacagtgaactattatccttaataaacgacatgccaataacaaatgaccaaaaaaaactaatgtccaataatgtccaaatagtaagacaacaaagctattcaattatgtgtataataaaagaagaagtattagcatacgtagttcaactaccactatatggcgttatagacacaccatgctggaaattacacacaagcccactatgcacaacaaatacaaaagaaggatccaacatttgcttaactagaactgacagaggatggtactgcgacaacgctggatcagtctctttcttcccacaagcagaaacctgtaaagtacaatcaaatagagtcttctgcgacacaatgaactcactaactctcccatctgaagtaaacttatgcaacatcgatatatttaacccaaaatacgattgtaaaataatgacatccaaaacagacgtttcatcaagcgtaatcacctccctcggagcaatcgtaagctgctacggtaaaacaaaatgcacagcatccaacaaaaacagaggcatcataaaaacattctcaaacggatgtgactatgtatcaaacaaaggagtagacacagtttcagtaggcaataccttatactgtgtcaataaacaagaaggacaatcactatatgtaaaaggagaacctataataaacttctacgaccccctcgtcttccctagcgatgaatttgacgcatcaatatcgcaagtaaacgaaaaaataaaccaatcattagcctttataagaaaatcagacgaattattacacaacgtaaacgtggggaaaagcacaactaacatcatgataacaactatcataattgtaatcatcgtcatcctattactcctaatcgcagtaggactattcctatactgcaaagctagatcaacaccagtcaccctatcgaaagatcaattgtcaggaataaacaatatagccttttcaaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14132 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut1 (opt11)
  source 1..1889: mol_type = other RNA
gggagactttcccattctgtagcagaatttggtgttgcctgtggtcttggtcccgcggagaagcttaccatggaactccccatcctcaaaacgaacgccatcacaaccatcctcgccgccgtcaccctctgcttcgcgtcatcccaaaacataactgaagagttctatcaatcaacctgctccgcagtctcaaaaggctacctcggcgccctacggaccggctggtacacaagcgtcatcacaatagaactttccaacatcaaagaaaacaaatgtaacggcaccgacgcaaaagtcaaactcataaaacaagaactagacaaatataaaaacgccgtaactgaactacaactcctcatgcaatcaactcctgcagccggtagcggctccgcaatctgctcaggcatcgcagtctgcaaagtcttacacctagaaggcgaagtcaacaaaatcaagaacgccctactatccacaaacaaagcagtagtctctctatccaacggagtctccgtcctcacattcaaagtactcgacctaaagaactacatcgacaaacaactactaccaatcttaaacaaacaatcctgctcaatccctaacattgaaaccgtcatagagttccaacagaaaaacaaccgcctcctcgaaataaccagagagttctcagtcaacgccggcgtcaccaccccggtctcaacctacatgctaaccaactctgaacttctcagcctaatcaacgacatgcccattaccaacgaccaaaagaaactcatgtccaataacgtccaaatcgttcgacaacaatcctactcaatcatgtgcatcataaaagaagaagtcctagcatacgtcgtccaactcccactatacggcgtaatcgacaccccctgctggaaactccacacctcccctctctgtaccaccaacaccaaagaagggtccaacatctgcctcacgcgcaccgaccgaggctggtattgcgacaatgcaggctctgtctccttcttcccccaagccgaaacctgcaaagtccaatctaaccgcgtcttctgcgacaccatgaacagtcttaccctcccgtcagaagtcaacctctgcaacatagatatcttcaacccaaaatacgactgcaaaatcatgacctcaaaaaccgacgtttcctcatccgttatcacctccctcggcgcaatcgtcagctgctacggcaagacaaagtgcacggcttcaaacaaaaaccgcggaatcatcaagacattcagcaacggctgcgactacgtatccaacaaaggagtggacacagtctccgttggaaacaccctctactgcgtaaacaaacaagaaggccaatcactctacgtcaaaggcgaacccatcatcaacttctacgacccactcgtcttcccctccgacgagttcgacgcctcaatcagccaagtcaacgagaaaattaaccagtcactcgccttcatacgcaaatccgacgaacttctacacaacgtaaacgtcggaaaatcaaccacaaacatcatgattaccacaattatcatagtcatcatagtaatcctcctgctactcatagcagtcggactcttcctatactgcaaagcccgctccacccctgtcaccctatccaaagaccaactttccggcatcaacaacatagccttttccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14133 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut1 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14134 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut1 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14135 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut1 (opt2)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14136 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut1 (opt3)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagaccaactcagtggcattaataacatcgcattctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14137 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut1 (opt4)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14138 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut1 (opt5)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagaccaactctctgggatcaataacattgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14139 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut1 (opt6)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttccaattctaaaaaccaatgctataacaacaatattagcagcagttacattatgcttcgcctcatcacaaaatatcacagaagaattttaccaatccacatgctcagcagtatctaaagggtacctaggagccctacgaacaggatggtacacatcagtaataacaatagaactctcaaacatcaaagaaaacaaatgcaatggaacagacgctaaagtaaaattaataaaacaagaactagacaaatacaaaaacgccgtcaccgaacttcagttactcatgcaaagcacacctgcagcaggatcaggttcagcaatatgctcaggaatagcagtttgcaaagtattacacctagaaggtgaagtcaacaaaataaaaaacgcacttctaagtactaacaaagctgtagtatcattatcaaacggagtatccgtactaacctttaaagtcctagacctaaaaaactacatagacaaacaactactcccaatactcaataaacaatcctgctcaattcccaacatcgaaacagtaatagaatttcaacaaaaaaacaatcgccttctagaaataacaagagaattttcagtcaacgccggagtaacaacaccagtatcaacatatatgctaacaaacagtgaactattatccttaataaacgacatgccaataacaaatgaccaaaaaaaactaatgtccaataatgtccaaatagtaagacaacaaagctattcaattatgtgtataataaaagaagaagtattagcatacgtagttcaactaccactatatggcgttatagacacaccatgctggaaattacacacaagcccactatgcacaacaaatacaaaagaaggatccaacatttgcttaactagaactgacagaggatggtactgcgacaacgctggatcagtctctttcttcccacaagcagaaacctgtaaagtacaatcaaatagagtcttctgcgacacaatgaactcactaactctcccatctgaagtaaacttatgcaacatcgatatatttaacccaaaatacgattgtaaaataatgacatccaaaacagacgtttcatcaagcgtaatcacctccctcggagcaatcgtaagctgctacggtaaaacaaaatgcacagcatccaacaaaaacagaggcatcataaaaacattctcaaacggatgtgactatgtatcaaacaaaggagtagacacagtttcagtaggcaataccttatactgtgtcaataaacaagaaggacaatcactatatgtaaaaggagaacctataataaacttctacgaccccctcgtcttccctagcgatgaatttgacgcatcaatatcgcaagtaaacgaaaaaataaaccaatcattagcctttataagaaaatcagacgaattattacacaacgtaaacgtggggaaaagcacaactaacatcatgataacaactatcataattgtaatcatcgtcatcctattactcctaatcgcagtaggactattcctatactgcaaagctagatcaacaccagtcaccctatcgaaagatcaattgtcaggaataaacaatatagccttttcaaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14140 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut1 (opt11)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactccccatcctcaaaacgaacgccatcacaaccatcctcgccgccgtcaccctctgcttcgcgtcatcccaaaacataactgaagagttctatcaatcaacctgctccgcagtctcaaaaggctacctcggcgccctacggaccggctggtacacaagcgtcatcacaatagaactttccaacatcaaagaaaacaaatgtaacggcaccgacgcaaaagtcaaactcataaaacaagaactagacaaatataaaaacgccgtaactgaactacaactcctcatgcaatcaactcctgcagccggtagcggctccgcaatctgctcaggcatcgcagtctgcaaagtcttacacctagaaggcgaagtcaacaaaatcaagaacgccctactatccacaaacaaagcagtagtctctctatccaacggagtctccgtcctcacattcaaagtactcgacctaaagaactacatcgacaaacaactactaccaatcttaaacaaacaatcctgctcaatccctaacattgaaaccgtcatagagttccaacagaaaaacaaccgcctcctcgaaataaccagagagttctcagtcaacgccggcgtcaccaccccggtctcaacctacatgctaaccaactctgaacttctcagcctaatcaacgacatgcccattaccaacgaccaaaagaaactcatgtccaataacgtccaaatcgttcgacaacaatcctactcaatcatgtgcatcataaaagaagaagtcctagcatacgtcgtccaactcccactatacggcgtaatcgacaccccctgctggaaactccacacctcccctctctgtaccaccaacaccaaagaagggtccaacatctgcctcacgcgcaccgaccgaggctggtattgcgacaatgcaggctctgtctccttcttcccccaagccgaaacctgcaaagtccaatctaaccgcgtcttctgcgacaccatgaacagtcttaccctcccgtcagaagtcaacctctgcaacatagatatcttcaacccaaaatacgactgcaaaatcatgacctcaaaaaccgacgtttcctcatccgttatcacctccctcggcgcaatcgtcagctgctacggcaagacaaagtgcacggcttcaaacaaaaaccgcggaatcatcaagacattcagcaacggctgcgactacgtatccaacaaaggagtggacacagtctccgttggaaacaccctctactgcgtaaacaaacaagaaggccaatcactctacgtcaaaggcgaacccatcatcaacttctacgacccactcgtcttcccctccgacgagttcgacgcctcaatcagccaagtcaacgagaaaattaaccagtcactcgccttcatacgcaaatccgacgaacttctacacaacgtaaacgtcggaaaatcaaccacaaacatcatgattaccacaattatcatagtcatcatagtaatcctcctgctactcatagcagtcggactcttcctatactgcaaagcccgctccacccctgtcaccctatccaaagaccaactttccggcatcaacaacatagccttttccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14141 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut1 (opt1)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14142 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut1 (opt1)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14143 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut1 (opt2)
  source 1..1910: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14144 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut1 (opt3)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagaccaactcagtggcattaataacatcgcattctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14145 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut1 (opt4)
  source 1..1910: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14146 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut1 (opt5)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagaccaactctctgggatcaataacattgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14147 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut1 (opt6)
  source 1..1910: mol_type = other RNA
gggagagcggctcggccattttgtcccagtcagtccggaggctgcggctgcagaagtaccgcctgcggagtaactgcaaagaagcttaccatggaacttccaattctaaaaaccaatgctataacaacaatattagcagcagttacattatgcttcgcctcatcacaaaatatcacagaagaattttaccaatccacatgctcagcagtatctaaagggtacctaggagccctacgaacaggatggtacacatcagtaataacaatagaactctcaaacatcaaagaaaacaaatgcaatggaacagacgctaaagtaaaattaataaaacaagaactagacaaatacaaaaacgccgtcaccgaacttcagttactcatgcaaagcacacctgcagcaggatcaggttcagcaatatgctcaggaatagcagtttgcaaagtattacacctagaaggtgaagtcaacaaaataaaaaacgcacttctaagtactaacaaagctgtagtatcattatcaaacggagtatccgtactaacctttaaagtcctagacctaaaaaactacatagacaaacaactactcccaatactcaataaacaatcctgctcaattcccaacatcgaaacagtaatagaatttcaacaaaaaaacaatcgccttctagaaataacaagagaattttcagtcaacgccggagtaacaacaccagtatcaacatatatgctaacaaacagtgaactattatccttaataaacgacatgccaataacaaatgaccaaaaaaaactaatgtccaataatgtccaaatagtaagacaacaaagctattcaattatgtgtataataaaagaagaagtattagcatacgtagttcaactaccactatatggcgttatagacacaccatgctggaaattacacacaagcccactatgcacaacaaatacaaaagaaggatccaacatttgcttaactagaactgacagaggatggtactgcgacaacgctggatcagtctctttcttcccacaagcagaaacctgtaaagtacaatcaaatagagtcttctgcgacacaatgaactcactaactctcccatctgaagtaaacttatgcaacatcgatatatttaacccaaaatacgattgtaaaataatgacatccaaaacagacgtttcatcaagcgtaatcacctccctcggagcaatcgtaagctgctacggtaaaacaaaatgcacagcatccaacaaaaacagaggcatcataaaaacattctcaaacggatgtgactatgtatcaaacaaaggagtagacacagtttcagtaggcaataccttatactgtgtcaataaacaagaaggacaatcactatatgtaaaaggagaacctataataaacttctacgaccccctcgtcttccctagcgatgaatttgacgcatcaatatcgcaagtaaacgaaaaaataaaccaatcattagcctttataagaaaatcagacgaattattacacaacgtaaacgtggggaaaagcacaactaacatcatgataacaactatcataattgtaatcatcgtcatcctattactcctaatcgcagtaggactattcctatactgcaaagctagatcaacaccagtcaccctatcgaaagatcaattgtcaggaataaacaatatagccttttcaaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14148 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut1 (opt11)
  source 1..1910: mol_type = other RNA
gggagagcggctcggccattttgtcccagtcagtccggaggctgcggctgcagaagtaccgcctgcggagtaactgcaaagaagcttaccatggaactccccatcctcaaaacgaacgccatcacaaccatcctcgccgccgtcaccctctgcttcgcgtcatcccaaaacataactgaagagttctatcaatcaacctgctccgcagtctcaaaaggctacctcggcgccctacggaccggctggtacacaagcgtcatcacaatagaactttccaacatcaaagaaaacaaatgtaacggcaccgacgcaaaagtcaaactcataaaacaagaactagacaaatataaaaacgccgtaactgaactacaactcctcatgcaatcaactcctgcagccggtagcggctccgcaatctgctcaggcatcgcagtctgcaaagtcttacacctagaaggcgaagtcaacaaaatcaagaacgccctactatccacaaacaaagcagtagtctctctatccaacggagtctccgtcctcacattcaaagtactcgacctaaagaactacatcgacaaacaactactaccaatcttaaacaaacaatcctgctcaatccctaacattgaaaccgtcatagagttccaacagaaaaacaaccgcctcctcgaaataaccagagagttctcagtcaacgccggcgtcaccaccccggtctcaacctacatgctaaccaactctgaacttctcagcctaatcaacgacatgcccattaccaacgaccaaaagaaactcatgtccaataacgtccaaatcgttcgacaacaatcctactcaatcatgtgcatcataaaagaagaagtcctagcatacgtcgtccaactcccactatacggcgtaatcgacaccccctgctggaaactccacacctcccctctctgtaccaccaacaccaaagaagggtccaacatctgcctcacgcgcaccgaccgaggctggtattgcgacaatgcaggctctgtctccttcttcccccaagccgaaacctgcaaagtccaatctaaccgcgtcttctgcgacaccatgaacagtcttaccctcccgtcagaagtcaacctctgcaacatagatatcttcaacccaaaatacgactgcaaaatcatgacctcaaaaaccgacgtttcctcatccgttatcacctccctcggcgcaatcgtcagctgctacggcaagacaaagtgcacggcttcaaacaaaaaccgcggaatcatcaagacattcagcaacggctgcgactacgtatccaacaaaggagtggacacagtctccgttggaaacaccctctactgcgtaaacaaacaagaaggccaatcactctacgtcaaaggcgaacccatcatcaacttctacgacccactcgtcttcccctccgacgagttcgacgcctcaatcagccaagtcaacgagaaaattaaccagtcactcgccttcatacgcaaatccgacgaacttctacacaacgtaaacgtcggaaaatcaaccacaaacatcatgattaccacaattatcatagtcatcatagtaatcctcctgctactcatagcagtcggactcttcctatactgcaaagcccgctccacccctgtcaccctatccaaagaccaactttccggcatcaacaacatagccttttccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14149 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut1 (opt1)
  source 1..1977: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14150 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut1 (opt1)
  source 1..1977: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14151 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut1 (opt2)
  source 1..1977: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14152 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut1 (opt3)
  source 1..1977: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagaccaactcagtggcattaataacatcgcattctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14153 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut1 (opt4)
  source 1..1977: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14154 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut1 (opt5)
  source 1..1977: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagaccaactctctgggatcaataacattgctttctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14155 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut1 (opt6)
  source 1..1977: mol_type = other RNA
gggagagcggctcggccattttgtcccagtcagtccggaggctgcggctgcagaagtaccgcctgcggagtaactgcaaagaagcttaccatggaacttccaattctaaaaaccaatgctataacaacaatattagcagcagttacattatgcttcgcctcatcacaaaatatcacagaagaattttaccaatccacatgctcagcagtatctaaagggtacctaggagccctacgaacaggatggtacacatcagtaataacaatagaactctcaaacatcaaagaaaacaaatgcaatggaacagacgctaaagtaaaattaataaaacaagaactagacaaatacaaaaacgccgtcaccgaacttcagttactcatgcaaagcacacctgcagcaggatcaggttcagcaatatgctcaggaatagcagtttgcaaagtattacacctagaaggtgaagtcaacaaaataaaaaacgcacttctaagtactaacaaagctgtagtatcattatcaaacggagtatccgtactaacctttaaagtcctagacctaaaaaactacatagacaaacaactactcccaatactcaataaacaatcctgctcaattcccaacatcgaaacagtaatagaatttcaacaaaaaaacaatcgccttctagaaataacaagagaattttcagtcaacgccggagtaacaacaccagtatcaacatatatgctaacaaacagtgaactattatccttaataaacgacatgccaataacaaatgaccaaaaaaaactaatgtccaataatgtccaaatagtaagacaacaaagctattcaattatgtgtataataaaagaagaagtattagcatacgtagttcaactaccactatatggcgttatagacacaccatgctggaaattacacacaagcccactatgcacaacaaatacaaaagaaggatccaacatttgcttaactagaactgacagaggatggtactgcgacaacgctggatcagtctctttcttcccacaagcagaaacctgtaaagtacaatcaaatagagtcttctgcgacacaatgaactcactaactctcccatctgaagtaaacttatgcaacatcgatatatttaacccaaaatacgattgtaaaataatgacatccaaaacagacgtttcatcaagcgtaatcacctccctcggagcaatcgtaagctgctacggtaaaacaaaatgcacagcatccaacaaaaacagaggcatcataaaaacattctcaaacggatgtgactatgtatcaaacaaaggagtagacacagtttcagtaggcaataccttatactgtgtcaataaacaagaaggacaatcactatatgtaaaaggagaacctataataaacttctacgaccccctcgtcttccctagcgatgaatttgacgcatcaatatcgcaagtaaacgaaaaaataaaccaatcattagcctttataagaaaatcagacgaattattacacaacgtaaacgtggggaaaagcacaactaacatcatgataacaactatcataattgtaatcatcgtcatcctattactcctaatcgcagtaggactattcctatactgcaaagctagatcaacaccagtcaccctatcgaaagatcaattgtcaggaataaacaatatagccttttcaaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14156 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut1 (opt11)
  source 1..1977: mol_type = other RNA
gggagagcggctcggccattttgtcccagtcagtccggaggctgcggctgcagaagtaccgcctgcggagtaactgcaaagaagcttaccatggaactccccatcctcaaaacgaacgccatcacaaccatcctcgccgccgtcaccctctgcttcgcgtcatcccaaaacataactgaagagttctatcaatcaacctgctccgcagtctcaaaaggctacctcggcgccctacggaccggctggtacacaagcgtcatcacaatagaactttccaacatcaaagaaaacaaatgtaacggcaccgacgcaaaagtcaaactcataaaacaagaactagacaaatataaaaacgccgtaactgaactacaactcctcatgcaatcaactcctgcagccggtagcggctccgcaatctgctcaggcatcgcagtctgcaaagtcttacacctagaaggcgaagtcaacaaaatcaagaacgccctactatccacaaacaaagcagtagtctctctatccaacggagtctccgtcctcacattcaaagtactcgacctaaagaactacatcgacaaacaactactaccaatcttaaacaaacaatcctgctcaatccctaacattgaaaccgtcatagagttccaacagaaaaacaaccgcctcctcgaaataaccagagagttctcagtcaacgccggcgtcaccaccccggtctcaacctacatgctaaccaactctgaacttctcagcctaatcaacgacatgcccattaccaacgaccaaaagaaactcatgtccaataacgtccaaatcgttcgacaacaatcctactcaatcatgtgcatcataaaagaagaagtcctagcatacgtcgtccaactcccactatacggcgtaatcgacaccccctgctggaaactccacacctcccctctctgtaccaccaacaccaaagaagggtccaacatctgcctcacgcgcaccgaccgaggctggtattgcgacaatgcaggctctgtctccttcttcccccaagccgaaacctgcaaagtccaatctaaccgcgtcttctgcgacaccatgaacagtcttaccctcccgtcagaagtcaacctctgcaacatagatatcttcaacccaaaatacgactgcaaaatcatgacctcaaaaaccgacgtttcctcatccgttatcacctccctcggcgcaatcgtcagctgctacggcaagacaaagtgcacggcttcaaacaaaaaccgcggaatcatcaagacattcagcaacggctgcgactacgtatccaacaaaggagtggacacagtctccgttggaaacaccctctactgcgtaaacaaacaagaaggccaatcactctacgtcaaaggcgaacccatcatcaacttctacgacccactcgtcttcccctccgacgagttcgacgcctcaatcagccaagtcaacgagaaaattaaccagtcactcgccttcatacgcaaatccgacgaacttctacacaacgtaaacgtcggaaaatcaaccacaaacatcatgattaccacaattatcatagtcatcatagtaatcctcctgctactcatagcagtcggactcttcctatactgcaaagcccgctccacccctgtcaccctatccaaagaccaactttccggcatcaacaacatagccttttccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14157 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut1 (opt1)
  source 1..2193: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14158 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut1 (opt1)
  source 1..2193: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14159 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut1 (opt2)
  source 1..2193: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14160 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut1 (opt3)
  source 1..2193: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagaccaactcagtggcattaataacatcgcattctctaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14161 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut1 (opt4)
  source 1..2193: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14162 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut1 (opt5)
  source 1..2193: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagaccaactctctgggatcaataacattgctttctccaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14163 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut1 (opt6)
  source 1..2193: mol_type = other RNA
gggagagcggctcggccattttgtcccagtcagtccggaggctgcggctgcagaagtaccgcctgcggagtaactgcaaagaagcttaccatggaacttccaattctaaaaaccaatgctataacaacaatattagcagcagttacattatgcttcgcctcatcacaaaatatcacagaagaattttaccaatccacatgctcagcagtatctaaagggtacctaggagccctacgaacaggatggtacacatcagtaataacaatagaactctcaaacatcaaagaaaacaaatgcaatggaacagacgctaaagtaaaattaataaaacaagaactagacaaatacaaaaacgccgtcaccgaacttcagttactcatgcaaagcacacctgcagcaggatcaggttcagcaatatgctcaggaatagcagtttgcaaagtattacacctagaaggtgaagtcaacaaaataaaaaacgcacttctaagtactaacaaagctgtagtatcattatcaaacggagtatccgtactaacctttaaagtcctagacctaaaaaactacatagacaaacaactactcccaatactcaataaacaatcctgctcaattcccaacatcgaaacagtaatagaatttcaacaaaaaaacaatcgccttctagaaataacaagagaattttcagtcaacgccggagtaacaacaccagtatcaacatatatgctaacaaacagtgaactattatccttaataaacgacatgccaataacaaatgaccaaaaaaaactaatgtccaataatgtccaaatagtaagacaacaaagctattcaattatgtgtataataaaagaagaagtattagcatacgtagttcaactaccactatatggcgttatagacacaccatgctggaaattacacacaagcccactatgcacaacaaatacaaaagaaggatccaacatttgcttaactagaactgacagaggatggtactgcgacaacgctggatcagtctctttcttcccacaagcagaaacctgtaaagtacaatcaaatagagtcttctgcgacacaatgaactcactaactctcccatctgaagtaaacttatgcaacatcgatatatttaacccaaaatacgattgtaaaataatgacatccaaaacagacgtttcatcaagcgtaatcacctccctcggagcaatcgtaagctgctacggtaaaacaaaatgcacagcatccaacaaaaacagaggcatcataaaaacattctcaaacggatgtgactatgtatcaaacaaaggagtagacacagtttcagtaggcaataccttatactgtgtcaataaacaagaaggacaatcactatatgtaaaaggagaacctataataaacttctacgaccccctcgtcttccctagcgatgaatttgacgcatcaatatcgcaagtaaacgaaaaaataaaccaatcattagcctttataagaaaatcagacgaattattacacaacgtaaacgtggggaaaagcacaactaacatcatgataacaactatcataattgtaatcatcgtcatcctattactcctaatcgcagtaggactattcctatactgcaaagctagatcaacaccagtcaccctatcgaaagatcaattgtcaggaataaacaatatagccttttcaaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14164 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut1 (opt11)
  source 1..2193: mol_type = other RNA
gggagagcggctcggccattttgtcccagtcagtccggaggctgcggctgcagaagtaccgcctgcggagtaactgcaaagaagcttaccatggaactccccatcctcaaaacgaacgccatcacaaccatcctcgccgccgtcaccctctgcttcgcgtcatcccaaaacataactgaagagttctatcaatcaacctgctccgcagtctcaaaaggctacctcggcgccctacggaccggctggtacacaagcgtcatcacaatagaactttccaacatcaaagaaaacaaatgtaacggcaccgacgcaaaagtcaaactcataaaacaagaactagacaaatataaaaacgccgtaactgaactacaactcctcatgcaatcaactcctgcagccggtagcggctccgcaatctgctcaggcatcgcagtctgcaaagtcttacacctagaaggcgaagtcaacaaaatcaagaacgccctactatccacaaacaaagcagtagtctctctatccaacggagtctccgtcctcacattcaaagtactcgacctaaagaactacatcgacaaacaactactaccaatcttaaacaaacaatcctgctcaatccctaacattgaaaccgtcatagagttccaacagaaaaacaaccgcctcctcgaaataaccagagagttctcagtcaacgccggcgtcaccaccccggtctcaacctacatgctaaccaactctgaacttctcagcctaatcaacgacatgcccattaccaacgaccaaaagaaactcatgtccaataacgtccaaatcgttcgacaacaatcctactcaatcatgtgcatcataaaagaagaagtcctagcatacgtcgtccaactcccactatacggcgtaatcgacaccccctgctggaaactccacacctcccctctctgtaccaccaacaccaaagaagggtccaacatctgcctcacgcgcaccgaccgaggctggtattgcgacaatgcaggctctgtctccttcttcccccaagccgaaacctgcaaagtccaatctaaccgcgtcttctgcgacaccatgaacagtcttaccctcccgtcagaagtcaacctctgcaacatagatatcttcaacccaaaatacgactgcaaaatcatgacctcaaaaaccgacgtttcctcatccgttatcacctccctcggcgcaatcgtcagctgctacggcaagacaaagtgcacggcttcaaacaaaaaccgcggaatcatcaagacattcagcaacggctgcgactacgtatccaacaaaggagtggacacagtctccgttggaaacaccctctactgcgtaaacaaacaagaaggccaatcactctacgtcaaaggcgaacccatcatcaacttctacgacccactcgtcttcccctccgacgagttcgacgcctcaatcagccaagtcaacgagaaaattaaccagtcactcgccttcatacgcaaatccgacgaacttctacacaacgtaaacgtcggaaaatcaaccacaaacatcatgattaccacaattatcatagtcatcatagtaatcctcctgctactcatagcagtcggactcttcctatactgcaaagcccgctccacccctgtcaccctatccaaagaccaactttccggcatcaacaacatagccttttccaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14165 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut1 (opt1)
  source 1..1973: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14166 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut1 (opt1)
  source 1..1973: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14167 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut1 (opt2)
  source 1..1973: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14168 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut1 (opt3)
  source 1..1973: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagaccaactcagtggcattaataacatcgcattctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14169 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut1 (opt4)
  source 1..1973: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14170 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut1 (opt5)
  source 1..1973: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagaccaactctctgggatcaataacattgctttctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14171 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut1 (opt6)
  source 1..1973: mol_type = other RNA
gggagagcggctcggccattttgtcccagtcagtccggaggctgcggctgcagaagtaccgcctgcggagtaactgcaaagaagcttaccatggaacttccaattctaaaaaccaatgctataacaacaatattagcagcagttacattatgcttcgcctcatcacaaaatatcacagaagaattttaccaatccacatgctcagcagtatctaaagggtacctaggagccctacgaacaggatggtacacatcagtaataacaatagaactctcaaacatcaaagaaaacaaatgcaatggaacagacgctaaagtaaaattaataaaacaagaactagacaaatacaaaaacgccgtcaccgaacttcagttactcatgcaaagcacacctgcagcaggatcaggttcagcaatatgctcaggaatagcagtttgcaaagtattacacctagaaggtgaagtcaacaaaataaaaaacgcacttctaagtactaacaaagctgtagtatcattatcaaacggagtatccgtactaacctttaaagtcctagacctaaaaaactacatagacaaacaactactcccaatactcaataaacaatcctgctcaattcccaacatcgaaacagtaatagaatttcaacaaaaaaacaatcgccttctagaaataacaagagaattttcagtcaacgccggagtaacaacaccagtatcaacatatatgctaacaaacagtgaactattatccttaataaacgacatgccaataacaaatgaccaaaaaaaactaatgtccaataatgtccaaatagtaagacaacaaagctattcaattatgtgtataataaaagaagaagtattagcatacgtagttcaactaccactatatggcgttatagacacaccatgctggaaattacacacaagcccactatgcacaacaaatacaaaagaaggatccaacatttgcttaactagaactgacagaggatggtactgcgacaacgctggatcagtctctttcttcccacaagcagaaacctgtaaagtacaatcaaatagagtcttctgcgacacaatgaactcactaactctcccatctgaagtaaacttatgcaacatcgatatatttaacccaaaatacgattgtaaaataatgacatccaaaacagacgtttcatcaagcgtaatcacctccctcggagcaatcgtaagctgctacggtaaaacaaaatgcacagcatccaacaaaaacagaggcatcataaaaacattctcaaacggatgtgactatgtatcaaacaaaggagtagacacagtttcagtaggcaataccttatactgtgtcaataaacaagaaggacaatcactatatgtaaaaggagaacctataataaacttctacgaccccctcgtcttccctagcgatgaatttgacgcatcaatatcgcaagtaaacgaaaaaataaaccaatcattagcctttataagaaaatcagacgaattattacacaacgtaaacgtggggaaaagcacaactaacatcatgataacaactatcataattgtaatcatcgtcatcctattactcctaatcgcagtaggactattcctatactgcaaagctagatcaacaccagtcaccctatcgaaagatcaattgtcaggaataaacaatatagccttttcaaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14172 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut1 (opt11)
  source 1..1973: mol_type = other RNA
gggagagcggctcggccattttgtcccagtcagtccggaggctgcggctgcagaagtaccgcctgcggagtaactgcaaagaagcttaccatggaactccccatcctcaaaacgaacgccatcacaaccatcctcgccgccgtcaccctctgcttcgcgtcatcccaaaacataactgaagagttctatcaatcaacctgctccgcagtctcaaaaggctacctcggcgccctacggaccggctggtacacaagcgtcatcacaatagaactttccaacatcaaagaaaacaaatgtaacggcaccgacgcaaaagtcaaactcataaaacaagaactagacaaatataaaaacgccgtaactgaactacaactcctcatgcaatcaactcctgcagccggtagcggctccgcaatctgctcaggcatcgcagtctgcaaagtcttacacctagaaggcgaagtcaacaaaatcaagaacgccctactatccacaaacaaagcagtagtctctctatccaacggagtctccgtcctcacattcaaagtactcgacctaaagaactacatcgacaaacaactactaccaatcttaaacaaacaatcctgctcaatccctaacattgaaaccgtcatagagttccaacagaaaaacaaccgcctcctcgaaataaccagagagttctcagtcaacgccggcgtcaccaccccggtctcaacctacatgctaaccaactctgaacttctcagcctaatcaacgacatgcccattaccaacgaccaaaagaaactcatgtccaataacgtccaaatcgttcgacaacaatcctactcaatcatgtgcatcataaaagaagaagtcctagcatacgtcgtccaactcccactatacggcgtaatcgacaccccctgctggaaactccacacctcccctctctgtaccaccaacaccaaagaagggtccaacatctgcctcacgcgcaccgaccgaggctggtattgcgacaatgcaggctctgtctccttcttcccccaagccgaaacctgcaaagtccaatctaaccgcgtcttctgcgacaccatgaacagtcttaccctcccgtcagaagtcaacctctgcaacatagatatcttcaacccaaaatacgactgcaaaatcatgacctcaaaaaccgacgtttcctcatccgttatcacctccctcggcgcaatcgtcagctgctacggcaagacaaagtgcacggcttcaaacaaaaaccgcggaatcatcaagacattcagcaacggctgcgactacgtatccaacaaaggagtggacacagtctccgttggaaacaccctctactgcgtaaacaaacaagaaggccaatcactctacgtcaaaggcgaacccatcatcaacttctacgacccactcgtcttcccctccgacgagttcgacgcctcaatcagccaagtcaacgagaaaattaaccagtcactcgccttcatacgcaaatccgacgaacttctacacaacgtaaacgtcggaaaatcaaccacaaacatcatgattaccacaattatcatagtcatcatagtaatcctcctgctactcatagcagtcggactcttcctatactgcaaagcccgctccacccctgtcaccctatccaaagaccaactttccggcatcaacaacatagccttttccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14173 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut1 (opt1)
  source 1..1964: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14174 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut1 (opt1)
  source 1..1964: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14175 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut1 (opt2)
  source 1..1964: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14176 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut1 (opt3)
  source 1..1964: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagaccaactcagtggcattaataacatcgcattctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14177 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut1 (opt4)
  source 1..1964: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14178 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut1 (opt5)
  source 1..1964: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagaccaactctctgggatcaataacattgctttctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14179 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut1 (opt6)
  source 1..1964: mol_type = other RNA
gggagagtcccgcagtcggcgtccagcggctctgcttgttcgtgtgtgtgtcgttgcaggccttattcaagcttaccatggaacttccaattctaaaaaccaatgctataacaacaatattagcagcagttacattatgcttcgcctcatcacaaaatatcacagaagaattttaccaatccacatgctcagcagtatctaaagggtacctaggagccctacgaacaggatggtacacatcagtaataacaatagaactctcaaacatcaaagaaaacaaatgcaatggaacagacgctaaagtaaaattaataaaacaagaactagacaaatacaaaaacgccgtcaccgaacttcagttactcatgcaaagcacacctgcagcaggatcaggttcagcaatatgctcaggaatagcagtttgcaaagtattacacctagaaggtgaagtcaacaaaataaaaaacgcacttctaagtactaacaaagctgtagtatcattatcaaacggagtatccgtactaacctttaaagtcctagacctaaaaaactacatagacaaacaactactcccaatactcaataaacaatcctgctcaattcccaacatcgaaacagtaatagaatttcaacaaaaaaacaatcgccttctagaaataacaagagaattttcagtcaacgccggagtaacaacaccagtatcaacatatatgctaacaaacagtgaactattatccttaataaacgacatgccaataacaaatgaccaaaaaaaactaatgtccaataatgtccaaatagtaagacaacaaagctattcaattatgtgtataataaaagaagaagtattagcatacgtagttcaactaccactatatggcgttatagacacaccatgctggaaattacacacaagcccactatgcacaacaaatacaaaagaaggatccaacatttgcttaactagaactgacagaggatggtactgcgacaacgctggatcagtctctttcttcccacaagcagaaacctgtaaagtacaatcaaatagagtcttctgcgacacaatgaactcactaactctcccatctgaagtaaacttatgcaacatcgatatatttaacccaaaatacgattgtaaaataatgacatccaaaacagacgtttcatcaagcgtaatcacctccctcggagcaatcgtaagctgctacggtaaaacaaaatgcacagcatccaacaaaaacagaggcatcataaaaacattctcaaacggatgtgactatgtatcaaacaaaggagtagacacagtttcagtaggcaataccttatactgtgtcaataaacaagaaggacaatcactatatgtaaaaggagaacctataataaacttctacgaccccctcgtcttccctagcgatgaatttgacgcatcaatatcgcaagtaaacgaaaaaataaaccaatcattagcctttataagaaaatcagacgaattattacacaacgtaaacgtggggaaaagcacaactaacatcatgataacaactatcataattgtaatcatcgtcatcctattactcctaatcgcagtaggactattcctatactgcaaagctagatcaacaccagtcaccctatcgaaagatcaattgtcaggaataaacaatatagccttttcaaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14180 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut1 (opt11)
  source 1..1964: mol_type = other RNA
gggagagtcccgcagtcggcgtccagcggctctgcttgttcgtgtgtgtgtcgttgcaggccttattcaagcttaccatggaactccccatcctcaaaacgaacgccatcacaaccatcctcgccgccgtcaccctctgcttcgcgtcatcccaaaacataactgaagagttctatcaatcaacctgctccgcagtctcaaaaggctacctcggcgccctacggaccggctggtacacaagcgtcatcacaatagaactttccaacatcaaagaaaacaaatgtaacggcaccgacgcaaaagtcaaactcataaaacaagaactagacaaatataaaaacgccgtaactgaactacaactcctcatgcaatcaactcctgcagccggtagcggctccgcaatctgctcaggcatcgcagtctgcaaagtcttacacctagaaggcgaagtcaacaaaatcaagaacgccctactatccacaaacaaagcagtagtctctctatccaacggagtctccgtcctcacattcaaagtactcgacctaaagaactacatcgacaaacaactactaccaatcttaaacaaacaatcctgctcaatccctaacattgaaaccgtcatagagttccaacagaaaaacaaccgcctcctcgaaataaccagagagttctcagtcaacgccggcgtcaccaccccggtctcaacctacatgctaaccaactctgaacttctcagcctaatcaacgacatgcccattaccaacgaccaaaagaaactcatgtccaataacgtccaaatcgttcgacaacaatcctactcaatcatgtgcatcataaaagaagaagtcctagcatacgtcgtccaactcccactatacggcgtaatcgacaccccctgctggaaactccacacctcccctctctgtaccaccaacaccaaagaagggtccaacatctgcctcacgcgcaccgaccgaggctggtattgcgacaatgcaggctctgtctccttcttcccccaagccgaaacctgcaaagtccaatctaaccgcgtcttctgcgacaccatgaacagtcttaccctcccgtcagaagtcaacctctgcaacatagatatcttcaacccaaaatacgactgcaaaatcatgacctcaaaaaccgacgtttcctcatccgttatcacctccctcggcgcaatcgtcagctgctacggcaagacaaagtgcacggcttcaaacaaaaaccgcggaatcatcaagacattcagcaacggctgcgactacgtatccaacaaaggagtggacacagtctccgttggaaacaccctctactgcgtaaacaaacaagaaggccaatcactctacgtcaaaggcgaacccatcatcaacttctacgacccactcgtcttcccctccgacgagttcgacgcctcaatcagccaagtcaacgagaaaattaaccagtcactcgccttcatacgcaaatccgacgaacttctacacaacgtaaacgtcggaaaatcaaccacaaacatcatgattaccacaattatcatagtcatcatagtaatcctcctgctactcatagcagtcggactcttcctatactgcaaagcccgctccacccctgtcaccctatccaaagaccaactttccggcatcaacaacatagccttttccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14181 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut1 (opt1)
  source 1..2180: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14182 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut1 (opt1)
  source 1..2180: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14183 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut1 (opt2)
  source 1..2180: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14184 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut1 (opt3)
  source 1..2180: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagaccaactcagtggcattaataacatcgcattctctaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14185 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut1 (opt4)
  source 1..2180: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14186 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut1 (opt5)
  source 1..2180: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagaccaactctctgggatcaataacattgctttctccaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14187 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut1 (opt6)
  source 1..2180: mol_type = other RNA
gggagagtcccgcagtcggcgtccagcggctctgcttgttcgtgtgtgtgtcgttgcaggccttattcaagcttaccatggaacttccaattctaaaaaccaatgctataacaacaatattagcagcagttacattatgcttcgcctcatcacaaaatatcacagaagaattttaccaatccacatgctcagcagtatctaaagggtacctaggagccctacgaacaggatggtacacatcagtaataacaatagaactctcaaacatcaaagaaaacaaatgcaatggaacagacgctaaagtaaaattaataaaacaagaactagacaaatacaaaaacgccgtcaccgaacttcagttactcatgcaaagcacacctgcagcaggatcaggttcagcaatatgctcaggaatagcagtttgcaaagtattacacctagaaggtgaagtcaacaaaataaaaaacgcacttctaagtactaacaaagctgtagtatcattatcaaacggagtatccgtactaacctttaaagtcctagacctaaaaaactacatagacaaacaactactcccaatactcaataaacaatcctgctcaattcccaacatcgaaacagtaatagaatttcaacaaaaaaacaatcgccttctagaaataacaagagaattttcagtcaacgccggagtaacaacaccagtatcaacatatatgctaacaaacagtgaactattatccttaataaacgacatgccaataacaaatgaccaaaaaaaactaatgtccaataatgtccaaatagtaagacaacaaagctattcaattatgtgtataataaaagaagaagtattagcatacgtagttcaactaccactatatggcgttatagacacaccatgctggaaattacacacaagcccactatgcacaacaaatacaaaagaaggatccaacatttgcttaactagaactgacagaggatggtactgcgacaacgctggatcagtctctttcttcccacaagcagaaacctgtaaagtacaatcaaatagagtcttctgcgacacaatgaactcactaactctcccatctgaagtaaacttatgcaacatcgatatatttaacccaaaatacgattgtaaaataatgacatccaaaacagacgtttcatcaagcgtaatcacctccctcggagcaatcgtaagctgctacggtaaaacaaaatgcacagcatccaacaaaaacagaggcatcataaaaacattctcaaacggatgtgactatgtatcaaacaaaggagtagacacagtttcagtaggcaataccttatactgtgtcaataaacaagaaggacaatcactatatgtaaaaggagaacctataataaacttctacgaccccctcgtcttccctagcgatgaatttgacgcatcaatatcgcaagtaaacgaaaaaataaaccaatcattagcctttataagaaaatcagacgaattattacacaacgtaaacgtggggaaaagcacaactaacatcatgataacaactatcataattgtaatcatcgtcatcctattactcctaatcgcagtaggactattcctatactgcaaagctagatcaacaccagtcaccctatcgaaagatcaattgtcaggaataaacaatatagccttttcaaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14188 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut1 (opt11)
  source 1..2180: mol_type = other RNA
gggagagtcccgcagtcggcgtccagcggctctgcttgttcgtgtgtgtgtcgttgcaggccttattcaagcttaccatggaactccccatcctcaaaacgaacgccatcacaaccatcctcgccgccgtcaccctctgcttcgcgtcatcccaaaacataactgaagagttctatcaatcaacctgctccgcagtctcaaaaggctacctcggcgccctacggaccggctggtacacaagcgtcatcacaatagaactttccaacatcaaagaaaacaaatgtaacggcaccgacgcaaaagtcaaactcataaaacaagaactagacaaatataaaaacgccgtaactgaactacaactcctcatgcaatcaactcctgcagccggtagcggctccgcaatctgctcaggcatcgcagtctgcaaagtcttacacctagaaggcgaagtcaacaaaatcaagaacgccctactatccacaaacaaagcagtagtctctctatccaacggagtctccgtcctcacattcaaagtactcgacctaaagaactacatcgacaaacaactactaccaatcttaaacaaacaatcctgctcaatccctaacattgaaaccgtcatagagttccaacagaaaaacaaccgcctcctcgaaataaccagagagttctcagtcaacgccggcgtcaccaccccggtctcaacctacatgctaaccaactctgaacttctcagcctaatcaacgacatgcccattaccaacgaccaaaagaaactcatgtccaataacgtccaaatcgttcgacaacaatcctactcaatcatgtgcatcataaaagaagaagtcctagcatacgtcgtccaactcccactatacggcgtaatcgacaccccctgctggaaactccacacctcccctctctgtaccaccaacaccaaagaagggtccaacatctgcctcacgcgcaccgaccgaggctggtattgcgacaatgcaggctctgtctccttcttcccccaagccgaaacctgcaaagtccaatctaaccgcgtcttctgcgacaccatgaacagtcttaccctcccgtcagaagtcaacctctgcaacatagatatcttcaacccaaaatacgactgcaaaatcatgacctcaaaaaccgacgtttcctcatccgttatcacctccctcggcgcaatcgtcagctgctacggcaagacaaagtgcacggcttcaaacaaaaaccgcggaatcatcaagacattcagcaacggctgcgactacgtatccaacaaaggagtggacacagtctccgttggaaacaccctctactgcgtaaacaaacaagaaggccaatcactctacgtcaaaggcgaacccatcatcaacttctacgacccactcgtcttcccctccgacgagttcgacgcctcaatcagccaagtcaacgagaaaattaaccagtcactcgccttcatacgcaaatccgacgaacttctacacaacgtaaacgtcggaaaatcaaccacaaacatcatgattaccacaattatcatagtcatcatagtaatcctcctgctactcatagcagtcggactcttcctatactgcaaagcccgctccacccctgtcaccctatccaaagaccaactttccggcatcaacaacatagccttttccaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14189 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut1 (opt1)
  source 1..1956: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14190 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut1 (opt1)
  source 1..1956: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14191 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut1 (opt2)
  source 1..1956: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14192 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut1 (opt3)
  source 1..1956: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagaccaactcagtggcattaataacatcgcattctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14193 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut1 (opt4)
  source 1..1956: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14194 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut1 (opt5)
  source 1..1956: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagaccaactctctgggatcaataacattgctttctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14195 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut1 (opt6)
  source 1..1956: mol_type = other RNA
gggagactttcccattctgtagcagaatttggtgttgcctgtggtcttggtcccgcggagaagcttaccatggaacttccaattctaaaaaccaatgctataacaacaatattagcagcagttacattatgcttcgcctcatcacaaaatatcacagaagaattttaccaatccacatgctcagcagtatctaaagggtacctaggagccctacgaacaggatggtacacatcagtaataacaatagaactctcaaacatcaaagaaaacaaatgcaatggaacagacgctaaagtaaaattaataaaacaagaactagacaaatacaaaaacgccgtcaccgaacttcagttactcatgcaaagcacacctgcagcaggatcaggttcagcaatatgctcaggaatagcagtttgcaaagtattacacctagaaggtgaagtcaacaaaataaaaaacgcacttctaagtactaacaaagctgtagtatcattatcaaacggagtatccgtactaacctttaaagtcctagacctaaaaaactacatagacaaacaactactcccaatactcaataaacaatcctgctcaattcccaacatcgaaacagtaatagaatttcaacaaaaaaacaatcgccttctagaaataacaagagaattttcagtcaacgccggagtaacaacaccagtatcaacatatatgctaacaaacagtgaactattatccttaataaacgacatgccaataacaaatgaccaaaaaaaactaatgtccaataatgtccaaatagtaagacaacaaagctattcaattatgtgtataataaaagaagaagtattagcatacgtagttcaactaccactatatggcgttatagacacaccatgctggaaattacacacaagcccactatgcacaacaaatacaaaagaaggatccaacatttgcttaactagaactgacagaggatggtactgcgacaacgctggatcagtctctttcttcccacaagcagaaacctgtaaagtacaatcaaatagagtcttctgcgacacaatgaactcactaactctcccatctgaagtaaacttatgcaacatcgatatatttaacccaaaatacgattgtaaaataatgacatccaaaacagacgtttcatcaagcgtaatcacctccctcggagcaatcgtaagctgctacggtaaaacaaaatgcacagcatccaacaaaaacagaggcatcataaaaacattctcaaacggatgtgactatgtatcaaacaaaggagtagacacagtttcagtaggcaataccttatactgtgtcaataaacaagaaggacaatcactatatgtaaaaggagaacctataataaacttctacgaccccctcgtcttccctagcgatgaatttgacgcatcaatatcgcaagtaaacgaaaaaataaaccaatcattagcctttataagaaaatcagacgaattattacacaacgtaaacgtggggaaaagcacaactaacatcatgataacaactatcataattgtaatcatcgtcatcctattactcctaatcgcagtaggactattcctatactgcaaagctagatcaacaccagtcaccctatcgaaagatcaattgtcaggaataaacaatatagccttttcaaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14196 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut1 (opt11)
  source 1..1956: mol_type = other RNA
gggagactttcccattctgtagcagaatttggtgttgcctgtggtcttggtcccgcggagaagcttaccatggaactccccatcctcaaaacgaacgccatcacaaccatcctcgccgccgtcaccctctgcttcgcgtcatcccaaaacataactgaagagttctatcaatcaacctgctccgcagtctcaaaaggctacctcggcgccctacggaccggctggtacacaagcgtcatcacaatagaactttccaacatcaaagaaaacaaatgtaacggcaccgacgcaaaagtcaaactcataaaacaagaactagacaaatataaaaacgccgtaactgaactacaactcctcatgcaatcaactcctgcagccggtagcggctccgcaatctgctcaggcatcgcagtctgcaaagtcttacacctagaaggcgaagtcaacaaaatcaagaacgccctactatccacaaacaaagcagtagtctctctatccaacggagtctccgtcctcacattcaaagtactcgacctaaagaactacatcgacaaacaactactaccaatcttaaacaaacaatcctgctcaatccctaacattgaaaccgtcatagagttccaacagaaaaacaaccgcctcctcgaaataaccagagagttctcagtcaacgccggcgtcaccaccccggtctcaacctacatgctaaccaactctgaacttctcagcctaatcaacgacatgcccattaccaacgaccaaaagaaactcatgtccaataacgtccaaatcgttcgacaacaatcctactcaatcatgtgcatcataaaagaagaagtcctagcatacgtcgtccaactcccactatacggcgtaatcgacaccccctgctggaaactccacacctcccctctctgtaccaccaacaccaaagaagggtccaacatctgcctcacgcgcaccgaccgaggctggtattgcgacaatgcaggctctgtctccttcttcccccaagccgaaacctgcaaagtccaatctaaccgcgtcttctgcgacaccatgaacagtcttaccctcccgtcagaagtcaacctctgcaacatagatatcttcaacccaaaatacgactgcaaaatcatgacctcaaaaaccgacgtttcctcatccgttatcacctccctcggcgcaatcgtcagctgctacggcaagacaaagtgcacggcttcaaacaaaaaccgcggaatcatcaagacattcagcaacggctgcgactacgtatccaacaaaggagtggacacagtctccgttggaaacaccctctactgcgtaaacaaacaagaaggccaatcactctacgtcaaaggcgaacccatcatcaacttctacgacccactcgtcttcccctccgacgagttcgacgcctcaatcagccaagtcaacgagaaaattaaccagtcactcgccttcatacgcaaatccgacgaacttctacacaacgtaaacgtcggaaaatcaaccacaaacatcatgattaccacaattatcatagtcatcatagtaatcctcctgctactcatagcagtcggactcttcctatactgcaaagcccgctccacccctgtcaccctatccaaagaccaactttccggcatcaacaacatagccttttccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14197 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut1 (opt1)
  source 1..1952: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14198 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut1 (opt1)
  source 1..1952: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14199 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut1 (opt2)
  source 1..1952: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14200 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut1 (opt3)
  source 1..1952: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagaccaactcagtggcattaataacatcgcattctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14201 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut1 (opt4)
  source 1..1952: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14202 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut1 (opt5)
  source 1..1952: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagaccaactctctgggatcaataacattgctttctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14203 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut1 (opt6)
  source 1..1952: mol_type = other RNA
gggagactttcccattctgtagcagaatttggtgttgcctgtggtcttggtcccgcggagaagcttaccatggaacttccaattctaaaaaccaatgctataacaacaatattagcagcagttacattatgcttcgcctcatcacaaaatatcacagaagaattttaccaatccacatgctcagcagtatctaaagggtacctaggagccctacgaacaggatggtacacatcagtaataacaatagaactctcaaacatcaaagaaaacaaatgcaatggaacagacgctaaagtaaaattaataaaacaagaactagacaaatacaaaaacgccgtcaccgaacttcagttactcatgcaaagcacacctgcagcaggatcaggttcagcaatatgctcaggaatagcagtttgcaaagtattacacctagaaggtgaagtcaacaaaataaaaaacgcacttctaagtactaacaaagctgtagtatcattatcaaacggagtatccgtactaacctttaaagtcctagacctaaaaaactacatagacaaacaactactcccaatactcaataaacaatcctgctcaattcccaacatcgaaacagtaatagaatttcaacaaaaaaacaatcgccttctagaaataacaagagaattttcagtcaacgccggagtaacaacaccagtatcaacatatatgctaacaaacagtgaactattatccttaataaacgacatgccaataacaaatgaccaaaaaaaactaatgtccaataatgtccaaatagtaagacaacaaagctattcaattatgtgtataataaaagaagaagtattagcatacgtagttcaactaccactatatggcgttatagacacaccatgctggaaattacacacaagcccactatgcacaacaaatacaaaagaaggatccaacatttgcttaactagaactgacagaggatggtactgcgacaacgctggatcagtctctttcttcccacaagcagaaacctgtaaagtacaatcaaatagagtcttctgcgacacaatgaactcactaactctcccatctgaagtaaacttatgcaacatcgatatatttaacccaaaatacgattgtaaaataatgacatccaaaacagacgtttcatcaagcgtaatcacctccctcggagcaatcgtaagctgctacggtaaaacaaaatgcacagcatccaacaaaaacagaggcatcataaaaacattctcaaacggatgtgactatgtatcaaacaaaggagtagacacagtttcagtaggcaataccttatactgtgtcaataaacaagaaggacaatcactatatgtaaaaggagaacctataataaacttctacgaccccctcgtcttccctagcgatgaatttgacgcatcaatatcgcaagtaaacgaaaaaataaaccaatcattagcctttataagaaaatcagacgaattattacacaacgtaaacgtggggaaaagcacaactaacatcatgataacaactatcataattgtaatcatcgtcatcctattactcctaatcgcagtaggactattcctatactgcaaagctagatcaacaccagtcaccctatcgaaagatcaattgtcaggaataaacaatatagccttttcaaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14204 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut1 (opt11)
  source 1..1952: mol_type = other RNA
gggagactttcccattctgtagcagaatttggtgttgcctgtggtcttggtcccgcggagaagcttaccatggaactccccatcctcaaaacgaacgccatcacaaccatcctcgccgccgtcaccctctgcttcgcgtcatcccaaaacataactgaagagttctatcaatcaacctgctccgcagtctcaaaaggctacctcggcgccctacggaccggctggtacacaagcgtcatcacaatagaactttccaacatcaaagaaaacaaatgtaacggcaccgacgcaaaagtcaaactcataaaacaagaactagacaaatataaaaacgccgtaactgaactacaactcctcatgcaatcaactcctgcagccggtagcggctccgcaatctgctcaggcatcgcagtctgcaaagtcttacacctagaaggcgaagtcaacaaaatcaagaacgccctactatccacaaacaaagcagtagtctctctatccaacggagtctccgtcctcacattcaaagtactcgacctaaagaactacatcgacaaacaactactaccaatcttaaacaaacaatcctgctcaatccctaacattgaaaccgtcatagagttccaacagaaaaacaaccgcctcctcgaaataaccagagagttctcagtcaacgccggcgtcaccaccccggtctcaacctacatgctaaccaactctgaacttctcagcctaatcaacgacatgcccattaccaacgaccaaaagaaactcatgtccaataacgtccaaatcgttcgacaacaatcctactcaatcatgtgcatcataaaagaagaagtcctagcatacgtcgtccaactcccactatacggcgtaatcgacaccccctgctggaaactccacacctcccctctctgtaccaccaacaccaaagaagggtccaacatctgcctcacgcgcaccgaccgaggctggtattgcgacaatgcaggctctgtctccttcttcccccaagccgaaacctgcaaagtccaatctaaccgcgtcttctgcgacaccatgaacagtcttaccctcccgtcagaagtcaacctctgcaacatagatatcttcaacccaaaatacgactgcaaaatcatgacctcaaaaaccgacgtttcctcatccgttatcacctccctcggcgcaatcgtcagctgctacggcaagacaaagtgcacggcttcaaacaaaaaccgcggaatcatcaagacattcagcaacggctgcgactacgtatccaacaaaggagtggacacagtctccgttggaaacaccctctactgcgtaaacaaacaagaaggccaatcactctacgtcaaaggcgaacccatcatcaacttctacgacccactcgtcttcccctccgacgagttcgacgcctcaatcagccaagtcaacgagaaaattaaccagtcactcgccttcatacgcaaatccgacgaacttctacacaacgtaaacgtcggaaaatcaaccacaaacatcatgattaccacaattatcatagtcatcatagtaatcctcctgctactcatagcagtcggactcttcctatactgcaaagcccgctccacccctgtcaccctatccaaagaccaactttccggcatcaacaacatagccttttccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14205 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut1 (opt1)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14206 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut1 (opt1)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14207 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut1 (opt2)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14208 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut1 (opt3)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagaccaactcagtggcattaataacatcgcattctctaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14209 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut1 (opt4)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14210 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut1 (opt5)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagaccaactctctgggatcaataacattgctttctccaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14211 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut1 (opt6)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggaacttccaattctaaaaaccaatgctataacaacaatattagcagcagttacattatgcttcgcctcatcacaaaatatcacagaagaattttaccaatccacatgctcagcagtatctaaagggtacctaggagccctacgaacaggatggtacacatcagtaataacaatagaactctcaaacatcaaagaaaacaaatgcaatggaacagacgctaaagtaaaattaataaaacaagaactagacaaatacaaaaacgccgtcaccgaacttcagttactcatgcaaagcacacctgcagcaggatcaggttcagcaatatgctcaggaatagcagtttgcaaagtattacacctagaaggtgaagtcaacaaaataaaaaacgcacttctaagtactaacaaagctgtagtatcattatcaaacggagtatccgtactaacctttaaagtcctagacctaaaaaactacatagacaaacaactactcccaatactcaataaacaatcctgctcaattcccaacatcgaaacagtaatagaatttcaacaaaaaaacaatcgccttctagaaataacaagagaattttcagtcaacgccggagtaacaacaccagtatcaacatatatgctaacaaacagtgaactattatccttaataaacgacatgccaataacaaatgaccaaaaaaaactaatgtccaataatgtccaaatagtaagacaacaaagctattcaattatgtgtataataaaagaagaagtattagcatacgtagttcaactaccactatatggcgttatagacacaccatgctggaaattacacacaagcccactatgcacaacaaatacaaaagaaggatccaacatttgcttaactagaactgacagaggatggtactgcgacaacgctggatcagtctctttcttcccacaagcagaaacctgtaaagtacaatcaaatagagtcttctgcgacacaatgaactcactaactctcccatctgaagtaaacttatgcaacatcgatatatttaacccaaaatacgattgtaaaataatgacatccaaaacagacgtttcatcaagcgtaatcacctccctcggagcaatcgtaagctgctacggtaaaacaaaatgcacagcatccaacaaaaacagaggcatcataaaaacattctcaaacggatgtgactatgtatcaaacaaaggagtagacacagtttcagtaggcaataccttatactgtgtcaataaacaagaaggacaatcactatatgtaaaaggagaacctataataaacttctacgaccccctcgtcttccctagcgatgaatttgacgcatcaatatcgcaagtaaacgaaaaaataaaccaatcattagcctttataagaaaatcagacgaattattacacaacgtaaacgtggggaaaagcacaactaacatcatgataacaactatcataattgtaatcatcgtcatcctattactcctaatcgcagtaggactattcctatactgcaaagctagatcaacaccagtcaccctatcgaaagatcaattgtcaggaataaacaatatagccttttcaaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14212 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut1 (opt11)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggaactccccatcctcaaaacgaacgccatcacaaccatcctcgccgccgtcaccctctgcttcgcgtcatcccaaaacataactgaagagttctatcaatcaacctgctccgcagtctcaaaaggctacctcggcgccctacggaccggctggtacacaagcgtcatcacaatagaactttccaacatcaaagaaaacaaatgtaacggcaccgacgcaaaagtcaaactcataaaacaagaactagacaaatataaaaacgccgtaactgaactacaactcctcatgcaatcaactcctgcagccggtagcggctccgcaatctgctcaggcatcgcagtctgcaaagtcttacacctagaaggcgaagtcaacaaaatcaagaacgccctactatccacaaacaaagcagtagtctctctatccaacggagtctccgtcctcacattcaaagtactcgacctaaagaactacatcgacaaacaactactaccaatcttaaacaaacaatcctgctcaatccctaacattgaaaccgtcatagagttccaacagaaaaacaaccgcctcctcgaaataaccagagagttctcagtcaacgccggcgtcaccaccccggtctcaacctacatgctaaccaactctgaacttctcagcctaatcaacgacatgcccattaccaacgaccaaaagaaactcatgtccaataacgtccaaatcgttcgacaacaatcctactcaatcatgtgcatcataaaagaagaagtcctagcatacgtcgtccaactcccactatacggcgtaatcgacaccccctgctggaaactccacacctcccctctctgtaccaccaacaccaaagaagggtccaacatctgcctcacgcgcaccgaccgaggctggtattgcgacaatgcaggctctgtctccttcttcccccaagccgaaacctgcaaagtccaatctaaccgcgtcttctgcgacaccatgaacagtcttaccctcccgtcagaagtcaacctctgcaacatagatatcttcaacccaaaatacgactgcaaaatcatgacctcaaaaaccgacgtttcctcatccgttatcacctccctcggcgcaatcgtcagctgctacggcaagacaaagtgcacggcttcaaacaaaaaccgcggaatcatcaagacattcagcaacggctgcgactacgtatccaacaaaggagtggacacagtctccgttggaaacaccctctactgcgtaaacaaacaagaaggccaatcactctacgtcaaaggcgaacccatcatcaacttctacgacccactcgtcttcccctccgacgagttcgacgcctcaatcagccaagtcaacgagaaaattaaccagtcactcgccttcatacgcaaatccgacgaacttctacacaacgtaaacgtcggaaaatcaaccacaaacatcatgattaccacaattatcatagtcatcatagtaatcctcctgctactcatagcagtcggactcttcctatactgcaaagcccgctccacccctgtcaccctatccaaagaccaactttccggcatcaacaacatagccttttccaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14213 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut1 (opt1)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14214 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut1 (opt1)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14215 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut1 (opt2)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14216 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut1 (opt3)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagaccaactcagtggcattaataacatcgcattctctaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14217 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut1 (opt4)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14218 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut1 (opt5)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagaccaactctctgggatcaataacattgctttctccaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14219 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut1 (opt6)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggaacttccaattctaaaaaccaatgctataacaacaatattagcagcagttacattatgcttcgcctcatcacaaaatatcacagaagaattttaccaatccacatgctcagcagtatctaaagggtacctaggagccctacgaacaggatggtacacatcagtaataacaatagaactctcaaacatcaaagaaaacaaatgcaatggaacagacgctaaagtaaaattaataaaacaagaactagacaaatacaaaaacgccgtcaccgaacttcagttactcatgcaaagcacacctgcagcaggatcaggttcagcaatatgctcaggaatagcagtttgcaaagtattacacctagaaggtgaagtcaacaaaataaaaaacgcacttctaagtactaacaaagctgtagtatcattatcaaacggagtatccgtactaacctttaaagtcctagacctaaaaaactacatagacaaacaactactcccaatactcaataaacaatcctgctcaattcccaacatcgaaacagtaatagaatttcaacaaaaaaacaatcgccttctagaaataacaagagaattttcagtcaacgccggagtaacaacaccagtatcaacatatatgctaacaaacagtgaactattatccttaataaacgacatgccaataacaaatgaccaaaaaaaactaatgtccaataatgtccaaatagtaagacaacaaagctattcaattatgtgtataataaaagaagaagtattagcatacgtagttcaactaccactatatggcgttatagacacaccatgctggaaattacacacaagcccactatgcacaacaaatacaaaagaaggatccaacatttgcttaactagaactgacagaggatggtactgcgacaacgctggatcagtctctttcttcccacaagcagaaacctgtaaagtacaatcaaatagagtcttctgcgacacaatgaactcactaactctcccatctgaagtaaacttatgcaacatcgatatatttaacccaaaatacgattgtaaaataatgacatccaaaacagacgtttcatcaagcgtaatcacctccctcggagcaatcgtaagctgctacggtaaaacaaaatgcacagcatccaacaaaaacagaggcatcataaaaacattctcaaacggatgtgactatgtatcaaacaaaggagtagacacagtttcagtaggcaataccttatactgtgtcaataaacaagaaggacaatcactatatgtaaaaggagaacctataataaacttctacgaccccctcgtcttccctagcgatgaatttgacgcatcaatatcgcaagtaaacgaaaaaataaaccaatcattagcctttataagaaaatcagacgaattattacacaacgtaaacgtggggaaaagcacaactaacatcatgataacaactatcataattgtaatcatcgtcatcctattactcctaatcgcagtaggactattcctatactgcaaagctagatcaacaccagtcaccctatcgaaagatcaattgtcaggaataaacaatatagccttttcaaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14220 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut1 (opt11)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggaactccccatcctcaaaacgaacgccatcacaaccatcctcgccgccgtcaccctctgcttcgcgtcatcccaaaacataactgaagagttctatcaatcaacctgctccgcagtctcaaaaggctacctcggcgccctacggaccggctggtacacaagcgtcatcacaatagaactttccaacatcaaagaaaacaaatgtaacggcaccgacgcaaaagtcaaactcataaaacaagaactagacaaatataaaaacgccgtaactgaactacaactcctcatgcaatcaactcctgcagccggtagcggctccgcaatctgctcaggcatcgcagtctgcaaagtcttacacctagaaggcgaagtcaacaaaatcaagaacgccctactatccacaaacaaagcagtagtctctctatccaacggagtctccgtcctcacattcaaagtactcgacctaaagaactacatcgacaaacaactactaccaatcttaaacaaacaatcctgctcaatccctaacattgaaaccgtcatagagttccaacagaaaaacaaccgcctcctcgaaataaccagagagttctcagtcaacgccggcgtcaccaccccggtctcaacctacatgctaaccaactctgaacttctcagcctaatcaacgacatgcccattaccaacgaccaaaagaaactcatgtccaataacgtccaaatcgttcgacaacaatcctactcaatcatgtgcatcataaaagaagaagtcctagcatacgtcgtccaactcccactatacggcgtaatcgacaccccctgctggaaactccacacctcccctctctgtaccaccaacaccaaagaagggtccaacatctgcctcacgcgcaccgaccgaggctggtattgcgacaatgcaggctctgtctccttcttcccccaagccgaaacctgcaaagtccaatctaaccgcgtcttctgcgacaccatgaacagtcttaccctcccgtcagaagtcaacctctgcaacatagatatcttcaacccaaaatacgactgcaaaatcatgacctcaaaaaccgacgtttcctcatccgttatcacctccctcggcgcaatcgtcagctgctacggcaagacaaagtgcacggcttcaaacaaaaaccgcggaatcatcaagacattcagcaacggctgcgactacgtatccaacaaaggagtggacacagtctccgttggaaacaccctctactgcgtaaacaaacaagaaggccaatcactctacgtcaaaggcgaacccatcatcaacttctacgacccactcgtcttcccctccgacgagttcgacgcctcaatcagccaagtcaacgagaaaattaaccagtcactcgccttcatacgcaaatccgacgaacttctacacaacgtaaacgtcggaaaatcaaccacaaacatcatgattaccacaattatcatagtcatcatagtaatcctcctgctactcatagcagtcggactcttcctatactgcaaagcccgctccacccctgtcaccctatccaaagaccaactttccggcatcaacaacatagccttttccaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14221 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut1 (opt1)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14222 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut1 (opt1)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14223 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut1 (opt2)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14224 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut1 (opt3)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagaccaactcagtggcattaataacatcgcattctctaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14225 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut1 (opt4)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14226 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut1 (opt5)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagaccaactctctgggatcaataacattgctttctccaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14227 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut1 (opt6)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttccaattctaaaaaccaatgctataacaacaatattagcagcagttacattatgcttcgcctcatcacaaaatatcacagaagaattttaccaatccacatgctcagcagtatctaaagggtacctaggagccctacgaacaggatggtacacatcagtaataacaatagaactctcaaacatcaaagaaaacaaatgcaatggaacagacgctaaagtaaaattaataaaacaagaactagacaaatacaaaaacgccgtcaccgaacttcagttactcatgcaaagcacacctgcagcaggatcaggttcagcaatatgctcaggaatagcagtttgcaaagtattacacctagaaggtgaagtcaacaaaataaaaaacgcacttctaagtactaacaaagctgtagtatcattatcaaacggagtatccgtactaacctttaaagtcctagacctaaaaaactacatagacaaacaactactcccaatactcaataaacaatcctgctcaattcccaacatcgaaacagtaatagaatttcaacaaaaaaacaatcgccttctagaaataacaagagaattttcagtcaacgccggagtaacaacaccagtatcaacatatatgctaacaaacagtgaactattatccttaataaacgacatgccaataacaaatgaccaaaaaaaactaatgtccaataatgtccaaatagtaagacaacaaagctattcaattatgtgtataataaaagaagaagtattagcatacgtagttcaactaccactatatggcgttatagacacaccatgctggaaattacacacaagcccactatgcacaacaaatacaaaagaaggatccaacatttgcttaactagaactgacagaggatggtactgcgacaacgctggatcagtctctttcttcccacaagcagaaacctgtaaagtacaatcaaatagagtcttctgcgacacaatgaactcactaactctcccatctgaagtaaacttatgcaacatcgatatatttaacccaaaatacgattgtaaaataatgacatccaaaacagacgtttcatcaagcgtaatcacctccctcggagcaatcgtaagctgctacggtaaaacaaaatgcacagcatccaacaaaaacagaggcatcataaaaacattctcaaacggatgtgactatgtatcaaacaaaggagtagacacagtttcagtaggcaataccttatactgtgtcaataaacaagaaggacaatcactatatgtaaaaggagaacctataataaacttctacgaccccctcgtcttccctagcgatgaatttgacgcatcaatatcgcaagtaaacgaaaaaataaaccaatcattagcctttataagaaaatcagacgaattattacacaacgtaaacgtggggaaaagcacaactaacatcatgataacaactatcataattgtaatcatcgtcatcctattactcctaatcgcagtaggactattcctatactgcaaagctagatcaacaccagtcaccctatcgaaagatcaattgtcaggaataaacaatatagccttttcaaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14228 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut1 (opt11)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactccccatcctcaaaacgaacgccatcacaaccatcctcgccgccgtcaccctctgcttcgcgtcatcccaaaacataactgaagagttctatcaatcaacctgctccgcagtctcaaaaggctacctcggcgccctacggaccggctggtacacaagcgtcatcacaatagaactttccaacatcaaagaaaacaaatgtaacggcaccgacgcaaaagtcaaactcataaaacaagaactagacaaatataaaaacgccgtaactgaactacaactcctcatgcaatcaactcctgcagccggtagcggctccgcaatctgctcaggcatcgcagtctgcaaagtcttacacctagaaggcgaagtcaacaaaatcaagaacgccctactatccacaaacaaagcagtagtctctctatccaacggagtctccgtcctcacattcaaagtactcgacctaaagaactacatcgacaaacaactactaccaatcttaaacaaacaatcctgctcaatccctaacattgaaaccgtcatagagttccaacagaaaaacaaccgcctcctcgaaataaccagagagttctcagtcaacgccggcgtcaccaccccggtctcaacctacatgctaaccaactctgaacttctcagcctaatcaacgacatgcccattaccaacgaccaaaagaaactcatgtccaataacgtccaaatcgttcgacaacaatcctactcaatcatgtgcatcataaaagaagaagtcctagcatacgtcgtccaactcccactatacggcgtaatcgacaccccctgctggaaactccacacctcccctctctgtaccaccaacaccaaagaagggtccaacatctgcctcacgcgcaccgaccgaggctggtattgcgacaatgcaggctctgtctccttcttcccccaagccgaaacctgcaaagtccaatctaaccgcgtcttctgcgacaccatgaacagtcttaccctcccgtcagaagtcaacctctgcaacatagatatcttcaacccaaaatacgactgcaaaatcatgacctcaaaaaccgacgtttcctcatccgttatcacctccctcggcgcaatcgtcagctgctacggcaagacaaagtgcacggcttcaaacaaaaaccgcggaatcatcaagacattcagcaacggctgcgactacgtatccaacaaaggagtggacacagtctccgttggaaacaccctctactgcgtaaacaaacaagaaggccaatcactctacgtcaaaggcgaacccatcatcaacttctacgacccactcgtcttcccctccgacgagttcgacgcctcaatcagccaagtcaacgagaaaattaaccagtcactcgccttcatacgcaaatccgacgaacttctacacaacgtaaacgtcggaaaatcaaccacaaacatcatgattaccacaattatcatagtcatcatagtaatcctcctgctactcatagcagtcggactcttcctatactgcaaagcccgctccacccctgtcaccctatccaaagaccaactttccggcatcaacaacatagccttttccaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14229 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut1 (opt1)
  source 1..1970: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14230 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut1 (opt1)
  source 1..1970: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14231 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut1 (opt2)
  source 1..1970: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14232 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut1 (opt3)
  source 1..1970: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagaccaactcagtggcattaataacatcgcattctctaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14233 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut1 (opt4)
  source 1..1970: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14234 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut1 (opt5)
  source 1..1970: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagaccaactctctgggatcaataacattgctttctccaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14235 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut1 (opt6)
  source 1..1970: mol_type = other RNA
gggagacccgtgacccggaagttgtacggctacgcgactttccctcccacaaaccctcgcgcccttcctttcctacttgggcccggcagaaagcttaccatggaacttccaattctaaaaaccaatgctataacaacaatattagcagcagttacattatgcttcgcctcatcacaaaatatcacagaagaattttaccaatccacatgctcagcagtatctaaagggtacctaggagccctacgaacaggatggtacacatcagtaataacaatagaactctcaaacatcaaagaaaacaaatgcaatggaacagacgctaaagtaaaattaataaaacaagaactagacaaatacaaaaacgccgtcaccgaacttcagttactcatgcaaagcacacctgcagcaggatcaggttcagcaatatgctcaggaatagcagtttgcaaagtattacacctagaaggtgaagtcaacaaaataaaaaacgcacttctaagtactaacaaagctgtagtatcattatcaaacggagtatccgtactaacctttaaagtcctagacctaaaaaactacatagacaaacaactactcccaatactcaataaacaatcctgctcaattcccaacatcgaaacagtaatagaatttcaacaaaaaaacaatcgccttctagaaataacaagagaattttcagtcaacgccggagtaacaacaccagtatcaacatatatgctaacaaacagtgaactattatccttaataaacgacatgccaataacaaatgaccaaaaaaaactaatgtccaataatgtccaaatagtaagacaacaaagctattcaattatgtgtataataaaagaagaagtattagcatacgtagttcaactaccactatatggcgttatagacacaccatgctggaaattacacacaagcccactatgcacaacaaatacaaaagaaggatccaacatttgcttaactagaactgacagaggatggtactgcgacaacgctggatcagtctctttcttcccacaagcagaaacctgtaaagtacaatcaaatagagtcttctgcgacacaatgaactcactaactctcccatctgaagtaaacttatgcaacatcgatatatttaacccaaaatacgattgtaaaataatgacatccaaaacagacgtttcatcaagcgtaatcacctccctcggagcaatcgtaagctgctacggtaaaacaaaatgcacagcatccaacaaaaacagaggcatcataaaaacattctcaaacggatgtgactatgtatcaaacaaaggagtagacacagtttcagtaggcaataccttatactgtgtcaataaacaagaaggacaatcactatatgtaaaaggagaacctataataaacttctacgaccccctcgtcttccctagcgatgaatttgacgcatcaatatcgcaagtaaacgaaaaaataaaccaatcattagcctttataagaaaatcagacgaattattacacaacgtaaacgtggggaaaagcacaactaacatcatgataacaactatcataattgtaatcatcgtcatcctattactcctaatcgcagtaggactattcctatactgcaaagctagatcaacaccagtcaccctatcgaaagatcaattgtcaggaataaacaatatagccttttcaaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14236 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut1 (opt11)
  source 1..1970: mol_type = other RNA
gggagacccgtgacccggaagttgtacggctacgcgactttccctcccacaaaccctcgcgcccttcctttcctacttgggcccggcagaaagcttaccatggaactccccatcctcaaaacgaacgccatcacaaccatcctcgccgccgtcaccctctgcttcgcgtcatcccaaaacataactgaagagttctatcaatcaacctgctccgcagtctcaaaaggctacctcggcgccctacggaccggctggtacacaagcgtcatcacaatagaactttccaacatcaaagaaaacaaatgtaacggcaccgacgcaaaagtcaaactcataaaacaagaactagacaaatataaaaacgccgtaactgaactacaactcctcatgcaatcaactcctgcagccggtagcggctccgcaatctgctcaggcatcgcagtctgcaaagtcttacacctagaaggcgaagtcaacaaaatcaagaacgccctactatccacaaacaaagcagtagtctctctatccaacggagtctccgtcctcacattcaaagtactcgacctaaagaactacatcgacaaacaactactaccaatcttaaacaaacaatcctgctcaatccctaacattgaaaccgtcatagagttccaacagaaaaacaaccgcctcctcgaaataaccagagagttctcagtcaacgccggcgtcaccaccccggtctcaacctacatgctaaccaactctgaacttctcagcctaatcaacgacatgcccattaccaacgaccaaaagaaactcatgtccaataacgtccaaatcgttcgacaacaatcctactcaatcatgtgcatcataaaagaagaagtcctagcatacgtcgtccaactcccactatacggcgtaatcgacaccccctgctggaaactccacacctcccctctctgtaccaccaacaccaaagaagggtccaacatctgcctcacgcgcaccgaccgaggctggtattgcgacaatgcaggctctgtctccttcttcccccaagccgaaacctgcaaagtccaatctaaccgcgtcttctgcgacaccatgaacagtcttaccctcccgtcagaagtcaacctctgcaacatagatatcttcaacccaaaatacgactgcaaaatcatgacctcaaaaaccgacgtttcctcatccgttatcacctccctcggcgcaatcgtcagctgctacggcaagacaaagtgcacggcttcaaacaaaaaccgcggaatcatcaagacattcagcaacggctgcgactacgtatccaacaaaggagtggacacagtctccgttggaaacaccctctactgcgtaaacaaacaagaaggccaatcactctacgtcaaaggcgaacccatcatcaacttctacgacccactcgtcttcccctccgacgagttcgacgcctcaatcagccaagtcaacgagaaaattaaccagtcactcgccttcatacgcaaatccgacgaacttctacacaacgtaaacgtcggaaaatcaaccacaaacatcatgattaccacaattatcatagtcatcatagtaatcctcctgctactcatagcagtcggactcttcctatactgcaaagcccgctccacccctgtcaccctatccaaagaccaactttccggcatcaacaacatagccttttccaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14237 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut1 (opt1)
  source 1..1986: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14238 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut1 (opt1)
  source 1..1986: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14239 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut1 (opt2)
  source 1..1986: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14240 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut1 (opt3)
  source 1..1986: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagaccaactcagtggcattaataacatcgcattctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14241 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut1 (opt4)
  source 1..1986: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14242 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut1 (opt5)
  source 1..1986: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagaccaactctctgggatcaataacattgctttctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14243 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut1 (opt6)
  source 1..1986: mol_type = other RNA
gggagacccgtgacccggaagttgtacggctacgcgactttccctcccacaaaccctcgcgcccttcctttcctacttgggcccggcagaaagcttaccatggaacttccaattctaaaaaccaatgctataacaacaatattagcagcagttacattatgcttcgcctcatcacaaaatatcacagaagaattttaccaatccacatgctcagcagtatctaaagggtacctaggagccctacgaacaggatggtacacatcagtaataacaatagaactctcaaacatcaaagaaaacaaatgcaatggaacagacgctaaagtaaaattaataaaacaagaactagacaaatacaaaaacgccgtcaccgaacttcagttactcatgcaaagcacacctgcagcaggatcaggttcagcaatatgctcaggaatagcagtttgcaaagtattacacctagaaggtgaagtcaacaaaataaaaaacgcacttctaagtactaacaaagctgtagtatcattatcaaacggagtatccgtactaacctttaaagtcctagacctaaaaaactacatagacaaacaactactcccaatactcaataaacaatcctgctcaattcccaacatcgaaacagtaatagaatttcaacaaaaaaacaatcgccttctagaaataacaagagaattttcagtcaacgccggagtaacaacaccagtatcaacatatatgctaacaaacagtgaactattatccttaataaacgacatgccaataacaaatgaccaaaaaaaactaatgtccaataatgtccaaatagtaagacaacaaagctattcaattatgtgtataataaaagaagaagtattagcatacgtagttcaactaccactatatggcgttatagacacaccatgctggaaattacacacaagcccactatgcacaacaaatacaaaagaaggatccaacatttgcttaactagaactgacagaggatggtactgcgacaacgctggatcagtctctttcttcccacaagcagaaacctgtaaagtacaatcaaatagagtcttctgcgacacaatgaactcactaactctcccatctgaagtaaacttatgcaacatcgatatatttaacccaaaatacgattgtaaaataatgacatccaaaacagacgtttcatcaagcgtaatcacctccctcggagcaatcgtaagctgctacggtaaaacaaaatgcacagcatccaacaaaaacagaggcatcataaaaacattctcaaacggatgtgactatgtatcaaacaaaggagtagacacagtttcagtaggcaataccttatactgtgtcaataaacaagaaggacaatcactatatgtaaaaggagaacctataataaacttctacgaccccctcgtcttccctagcgatgaatttgacgcatcaatatcgcaagtaaacgaaaaaataaaccaatcattagcctttataagaaaatcagacgaattattacacaacgtaaacgtggggaaaagcacaactaacatcatgataacaactatcataattgtaatcatcgtcatcctattactcctaatcgcagtaggactattcctatactgcaaagctagatcaacaccagtcaccctatcgaaagatcaattgtcaggaataaacaatatagccttttcaaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14244 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut1 (opt11)
  source 1..1986: mol_type = other RNA
gggagacccgtgacccggaagttgtacggctacgcgactttccctcccacaaaccctcgcgcccttcctttcctacttgggcccggcagaaagcttaccatggaactccccatcctcaaaacgaacgccatcacaaccatcctcgccgccgtcaccctctgcttcgcgtcatcccaaaacataactgaagagttctatcaatcaacctgctccgcagtctcaaaaggctacctcggcgccctacggaccggctggtacacaagcgtcatcacaatagaactttccaacatcaaagaaaacaaatgtaacggcaccgacgcaaaagtcaaactcataaaacaagaactagacaaatataaaaacgccgtaactgaactacaactcctcatgcaatcaactcctgcagccggtagcggctccgcaatctgctcaggcatcgcagtctgcaaagtcttacacctagaaggcgaagtcaacaaaatcaagaacgccctactatccacaaacaaagcagtagtctctctatccaacggagtctccgtcctcacattcaaagtactcgacctaaagaactacatcgacaaacaactactaccaatcttaaacaaacaatcctgctcaatccctaacattgaaaccgtcatagagttccaacagaaaaacaaccgcctcctcgaaataaccagagagttctcagtcaacgccggcgtcaccaccccggtctcaacctacatgctaaccaactctgaacttctcagcctaatcaacgacatgcccattaccaacgaccaaaagaaactcatgtccaataacgtccaaatcgttcgacaacaatcctactcaatcatgtgcatcataaaagaagaagtcctagcatacgtcgtccaactcccactatacggcgtaatcgacaccccctgctggaaactccacacctcccctctctgtaccaccaacaccaaagaagggtccaacatctgcctcacgcgcaccgaccgaggctggtattgcgacaatgcaggctctgtctccttcttcccccaagccgaaacctgcaaagtccaatctaaccgcgtcttctgcgacaccatgaacagtcttaccctcccgtcagaagtcaacctctgcaacatagatatcttcaacccaaaatacgactgcaaaatcatgacctcaaaaaccgacgtttcctcatccgttatcacctccctcggcgcaatcgtcagctgctacggcaagacaaagtgcacggcttcaaacaaaaaccgcggaatcatcaagacattcagcaacggctgcgactacgtatccaacaaaggagtggacacagtctccgttggaaacaccctctactgcgtaaacaaacaagaaggccaatcactctacgtcaaaggcgaacccatcatcaacttctacgacccactcgtcttcccctccgacgagttcgacgcctcaatcagccaagtcaacgagaaaattaaccagtcactcgccttcatacgcaaatccgacgaacttctacacaacgtaaacgtcggaaaatcaaccacaaacatcatgattaccacaattatcatagtcatcatagtaatcctcctgctactcatagcagtcggactcttcctatactgcaaagcccgctccacccctgtcaccctatccaaagaccaactttccggcatcaacaacatagccttttccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14245 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut1 (opt1)
  source 1..2202: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14246 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut1 (opt1)
  source 1..2202: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14247 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut1 (opt2)
  source 1..2202: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14248 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut1 (opt3)
  source 1..2202: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagaccaactcagtggcattaataacatcgcattctctaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14249 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut1 (opt4)
  source 1..2202: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14250 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut1 (opt5)
  source 1..2202: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagaccaactctctgggatcaataacattgctttctccaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14251 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut1 (opt6)
  source 1..2202: mol_type = other RNA
gggagacccgtgacccggaagttgtacggctacgcgactttccctcccacaaaccctcgcgcccttcctttcctacttgggcccggcagaaagcttaccatggaacttccaattctaaaaaccaatgctataacaacaatattagcagcagttacattatgcttcgcctcatcacaaaatatcacagaagaattttaccaatccacatgctcagcagtatctaaagggtacctaggagccctacgaacaggatggtacacatcagtaataacaatagaactctcaaacatcaaagaaaacaaatgcaatggaacagacgctaaagtaaaattaataaaacaagaactagacaaatacaaaaacgccgtcaccgaacttcagttactcatgcaaagcacacctgcagcaggatcaggttcagcaatatgctcaggaatagcagtttgcaaagtattacacctagaaggtgaagtcaacaaaataaaaaacgcacttctaagtactaacaaagctgtagtatcattatcaaacggagtatccgtactaacctttaaagtcctagacctaaaaaactacatagacaaacaactactcccaatactcaataaacaatcctgctcaattcccaacatcgaaacagtaatagaatttcaacaaaaaaacaatcgccttctagaaataacaagagaattttcagtcaacgccggagtaacaacaccagtatcaacatatatgctaacaaacagtgaactattatccttaataaacgacatgccaataacaaatgaccaaaaaaaactaatgtccaataatgtccaaatagtaagacaacaaagctattcaattatgtgtataataaaagaagaagtattagcatacgtagttcaactaccactatatggcgttatagacacaccatgctggaaattacacacaagcccactatgcacaacaaatacaaaagaaggatccaacatttgcttaactagaactgacagaggatggtactgcgacaacgctggatcagtctctttcttcccacaagcagaaacctgtaaagtacaatcaaatagagtcttctgcgacacaatgaactcactaactctcccatctgaagtaaacttatgcaacatcgatatatttaacccaaaatacgattgtaaaataatgacatccaaaacagacgtttcatcaagcgtaatcacctccctcggagcaatcgtaagctgctacggtaaaacaaaatgcacagcatccaacaaaaacagaggcatcataaaaacattctcaaacggatgtgactatgtatcaaacaaaggagtagacacagtttcagtaggcaataccttatactgtgtcaataaacaagaaggacaatcactatatgtaaaaggagaacctataataaacttctacgaccccctcgtcttccctagcgatgaatttgacgcatcaatatcgcaagtaaacgaaaaaataaaccaatcattagcctttataagaaaatcagacgaattattacacaacgtaaacgtggggaaaagcacaactaacatcatgataacaactatcataattgtaatcatcgtcatcctattactcctaatcgcagtaggactattcctatactgcaaagctagatcaacaccagtcaccctatcgaaagatcaattgtcaggaataaacaatatagccttttcaaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14252 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut1 (opt11)
  source 1..2202: mol_type = other RNA
gggagacccgtgacccggaagttgtacggctacgcgactttccctcccacaaaccctcgcgcccttcctttcctacttgggcccggcagaaagcttaccatggaactccccatcctcaaaacgaacgccatcacaaccatcctcgccgccgtcaccctctgcttcgcgtcatcccaaaacataactgaagagttctatcaatcaacctgctccgcagtctcaaaaggctacctcggcgccctacggaccggctggtacacaagcgtcatcacaatagaactttccaacatcaaagaaaacaaatgtaacggcaccgacgcaaaagtcaaactcataaaacaagaactagacaaatataaaaacgccgtaactgaactacaactcctcatgcaatcaactcctgcagccggtagcggctccgcaatctgctcaggcatcgcagtctgcaaagtcttacacctagaaggcgaagtcaacaaaatcaagaacgccctactatccacaaacaaagcagtagtctctctatccaacggagtctccgtcctcacattcaaagtactcgacctaaagaactacatcgacaaacaactactaccaatcttaaacaaacaatcctgctcaatccctaacattgaaaccgtcatagagttccaacagaaaaacaaccgcctcctcgaaataaccagagagttctcagtcaacgccggcgtcaccaccccggtctcaacctacatgctaaccaactctgaacttctcagcctaatcaacgacatgcccattaccaacgaccaaaagaaactcatgtccaataacgtccaaatcgttcgacaacaatcctactcaatcatgtgcatcataaaagaagaagtcctagcatacgtcgtccaactcccactatacggcgtaatcgacaccccctgctggaaactccacacctcccctctctgtaccaccaacaccaaagaagggtccaacatctgcctcacgcgcaccgaccgaggctggtattgcgacaatgcaggctctgtctccttcttcccccaagccgaaacctgcaaagtccaatctaaccgcgtcttctgcgacaccatgaacagtcttaccctcccgtcagaagtcaacctctgcaacatagatatcttcaacccaaaatacgactgcaaaatcatgacctcaaaaaccgacgtttcctcatccgttatcacctccctcggcgcaatcgtcagctgctacggcaagacaaagtgcacggcttcaaacaaaaaccgcggaatcatcaagacattcagcaacggctgcgactacgtatccaacaaaggagtggacacagtctccgttggaaacaccctctactgcgtaaacaaacaagaaggccaatcactctacgtcaaaggcgaacccatcatcaacttctacgacccactcgtcttcccctccgacgagttcgacgcctcaatcagccaagtcaacgagaaaattaaccagtcactcgccttcatacgcaaatccgacgaacttctacacaacgtaaacgtcggaaaatcaaccacaaacatcatgattaccacaattatcatagtcatcatagtaatcctcctgctactcatagcagtcggactcttcctatactgcaaagcccgctccacccctgtcaccctatccaaagaccaactttccggcatcaacaacatagccttttccaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14253 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut1 (opt1)
  source 1..1982: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14254 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut1 (opt1)
  source 1..1982: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14255 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut1 (opt2)
  source 1..1982: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14256 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut1 (opt3)
  source 1..1982: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagaccaactcagtggcattaataacatcgcattctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14257 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut1 (opt4)
  source 1..1982: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14258 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut1 (opt5)
  source 1..1982: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagaccaactctctgggatcaataacattgctttctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14259 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut1 (opt6)
  source 1..1982: mol_type = other RNA
gggagacccgtgacccggaagttgtacggctacgcgactttccctcccacaaaccctcgcgcccttcctttcctacttgggcccggcagaaagcttaccatggaacttccaattctaaaaaccaatgctataacaacaatattagcagcagttacattatgcttcgcctcatcacaaaatatcacagaagaattttaccaatccacatgctcagcagtatctaaagggtacctaggagccctacgaacaggatggtacacatcagtaataacaatagaactctcaaacatcaaagaaaacaaatgcaatggaacagacgctaaagtaaaattaataaaacaagaactagacaaatacaaaaacgccgtcaccgaacttcagttactcatgcaaagcacacctgcagcaggatcaggttcagcaatatgctcaggaatagcagtttgcaaagtattacacctagaaggtgaagtcaacaaaataaaaaacgcacttctaagtactaacaaagctgtagtatcattatcaaacggagtatccgtactaacctttaaagtcctagacctaaaaaactacatagacaaacaactactcccaatactcaataaacaatcctgctcaattcccaacatcgaaacagtaatagaatttcaacaaaaaaacaatcgccttctagaaataacaagagaattttcagtcaacgccggagtaacaacaccagtatcaacatatatgctaacaaacagtgaactattatccttaataaacgacatgccaataacaaatgaccaaaaaaaactaatgtccaataatgtccaaatagtaagacaacaaagctattcaattatgtgtataataaaagaagaagtattagcatacgtagttcaactaccactatatggcgttatagacacaccatgctggaaattacacacaagcccactatgcacaacaaatacaaaagaaggatccaacatttgcttaactagaactgacagaggatggtactgcgacaacgctggatcagtctctttcttcccacaagcagaaacctgtaaagtacaatcaaatagagtcttctgcgacacaatgaactcactaactctcccatctgaagtaaacttatgcaacatcgatatatttaacccaaaatacgattgtaaaataatgacatccaaaacagacgtttcatcaagcgtaatcacctccctcggagcaatcgtaagctgctacggtaaaacaaaatgcacagcatccaacaaaaacagaggcatcataaaaacattctcaaacggatgtgactatgtatcaaacaaaggagtagacacagtttcagtaggcaataccttatactgtgtcaataaacaagaaggacaatcactatatgtaaaaggagaacctataataaacttctacgaccccctcgtcttccctagcgatgaatttgacgcatcaatatcgcaagtaaacgaaaaaataaaccaatcattagcctttataagaaaatcagacgaattattacacaacgtaaacgtggggaaaagcacaactaacatcatgataacaactatcataattgtaatcatcgtcatcctattactcctaatcgcagtaggactattcctatactgcaaagctagatcaacaccagtcaccctatcgaaagatcaattgtcaggaataaacaatatagccttttcaaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14260 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut1 (opt11)
  source 1..1982: mol_type = other RNA
gggagacccgtgacccggaagttgtacggctacgcgactttccctcccacaaaccctcgcgcccttcctttcctacttgggcccggcagaaagcttaccatggaactccccatcctcaaaacgaacgccatcacaaccatcctcgccgccgtcaccctctgcttcgcgtcatcccaaaacataactgaagagttctatcaatcaacctgctccgcagtctcaaaaggctacctcggcgccctacggaccggctggtacacaagcgtcatcacaatagaactttccaacatcaaagaaaacaaatgtaacggcaccgacgcaaaagtcaaactcataaaacaagaactagacaaatataaaaacgccgtaactgaactacaactcctcatgcaatcaactcctgcagccggtagcggctccgcaatctgctcaggcatcgcagtctgcaaagtcttacacctagaaggcgaagtcaacaaaatcaagaacgccctactatccacaaacaaagcagtagtctctctatccaacggagtctccgtcctcacattcaaagtactcgacctaaagaactacatcgacaaacaactactaccaatcttaaacaaacaatcctgctcaatccctaacattgaaaccgtcatagagttccaacagaaaaacaaccgcctcctcgaaataaccagagagttctcagtcaacgccggcgtcaccaccccggtctcaacctacatgctaaccaactctgaacttctcagcctaatcaacgacatgcccattaccaacgaccaaaagaaactcatgtccaataacgtccaaatcgttcgacaacaatcctactcaatcatgtgcatcataaaagaagaagtcctagcatacgtcgtccaactcccactatacggcgtaatcgacaccccctgctggaaactccacacctcccctctctgtaccaccaacaccaaagaagggtccaacatctgcctcacgcgcaccgaccgaggctggtattgcgacaatgcaggctctgtctccttcttcccccaagccgaaacctgcaaagtccaatctaaccgcgtcttctgcgacaccatgaacagtcttaccctcccgtcagaagtcaacctctgcaacatagatatcttcaacccaaaatacgactgcaaaatcatgacctcaaaaaccgacgtttcctcatccgttatcacctccctcggcgcaatcgtcagctgctacggcaagacaaagtgcacggcttcaaacaaaaaccgcggaatcatcaagacattcagcaacggctgcgactacgtatccaacaaaggagtggacacagtctccgttggaaacaccctctactgcgtaaacaaacaagaaggccaatcactctacgtcaaaggcgaacccatcatcaacttctacgacccactcgtcttcccctccgacgagttcgacgcctcaatcagccaagtcaacgagaaaattaaccagtcactcgccttcatacgcaaatccgacgaacttctacacaacgtaaacgtcggaaaatcaaccacaaacatcatgattaccacaattatcatagtcatcatagtaatcctcctgctactcatagcagtcggactcttcctatactgcaaagcccgctccacccctgtcaccctatccaaagaccaactttccggcatcaacaacatagccttttccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14261 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut1 (opt1)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14262 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut1 (opt1)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14263 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut1 (opt2)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14264 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut1 (opt3)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagaccaactcagtggcattaataacatcgcattctctaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14265 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut1 (opt4)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14266 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut1 (opt5)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagaccaactctctgggatcaataacattgctttctccaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14267 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut1 (opt6)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttccaattctaaaaaccaatgctataacaacaatattagcagcagttacattatgcttcgcctcatcacaaaatatcacagaagaattttaccaatccacatgctcagcagtatctaaagggtacctaggagccctacgaacaggatggtacacatcagtaataacaatagaactctcaaacatcaaagaaaacaaatgcaatggaacagacgctaaagtaaaattaataaaacaagaactagacaaatacaaaaacgccgtcaccgaacttcagttactcatgcaaagcacacctgcagcaggatcaggttcagcaatatgctcaggaatagcagtttgcaaagtattacacctagaaggtgaagtcaacaaaataaaaaacgcacttctaagtactaacaaagctgtagtatcattatcaaacggagtatccgtactaacctttaaagtcctagacctaaaaaactacatagacaaacaactactcccaatactcaataaacaatcctgctcaattcccaacatcgaaacagtaatagaatttcaacaaaaaaacaatcgccttctagaaataacaagagaattttcagtcaacgccggagtaacaacaccagtatcaacatatatgctaacaaacagtgaactattatccttaataaacgacatgccaataacaaatgaccaaaaaaaactaatgtccaataatgtccaaatagtaagacaacaaagctattcaattatgtgtataataaaagaagaagtattagcatacgtagttcaactaccactatatggcgttatagacacaccatgctggaaattacacacaagcccactatgcacaacaaatacaaaagaaggatccaacatttgcttaactagaactgacagaggatggtactgcgacaacgctggatcagtctctttcttcccacaagcagaaacctgtaaagtacaatcaaatagagtcttctgcgacacaatgaactcactaactctcccatctgaagtaaacttatgcaacatcgatatatttaacccaaaatacgattgtaaaataatgacatccaaaacagacgtttcatcaagcgtaatcacctccctcggagcaatcgtaagctgctacggtaaaacaaaatgcacagcatccaacaaaaacagaggcatcataaaaacattctcaaacggatgtgactatgtatcaaacaaaggagtagacacagtttcagtaggcaataccttatactgtgtcaataaacaagaaggacaatcactatatgtaaaaggagaacctataataaacttctacgaccccctcgtcttccctagcgatgaatttgacgcatcaatatcgcaagtaaacgaaaaaataaaccaatcattagcctttataagaaaatcagacgaattattacacaacgtaaacgtggggaaaagcacaactaacatcatgataacaactatcataattgtaatcatcgtcatcctattactcctaatcgcagtaggactattcctatactgcaaagctagatcaacaccagtcaccctatcgaaagatcaattgtcaggaataaacaatatagccttttcaaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14268 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut1 (opt11)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatcctcaaaacgaacgccatcacaaccatcctcgccgccgtcaccctctgcttcgcgtcatcccaaaacataactgaagagttctatcaatcaacctgctccgcagtctcaaaaggctacctcggcgccctacggaccggctggtacacaagcgtcatcacaatagaactttccaacatcaaagaaaacaaatgtaacggcaccgacgcaaaagtcaaactcataaaacaagaactagacaaatataaaaacgccgtaactgaactacaactcctcatgcaatcaactcctgcagccggtagcggctccgcaatctgctcaggcatcgcagtctgcaaagtcttacacctagaaggcgaagtcaacaaaatcaagaacgccctactatccacaaacaaagcagtagtctctctatccaacggagtctccgtcctcacattcaaagtactcgacctaaagaactacatcgacaaacaactactaccaatcttaaacaaacaatcctgctcaatccctaacattgaaaccgtcatagagttccaacagaaaaacaaccgcctcctcgaaataaccagagagttctcagtcaacgccggcgtcaccaccccggtctcaacctacatgctaaccaactctgaacttctcagcctaatcaacgacatgcccattaccaacgaccaaaagaaactcatgtccaataacgtccaaatcgttcgacaacaatcctactcaatcatgtgcatcataaaagaagaagtcctagcatacgtcgtccaactcccactatacggcgtaatcgacaccccctgctggaaactccacacctcccctctctgtaccaccaacaccaaagaagggtccaacatctgcctcacgcgcaccgaccgaggctggtattgcgacaatgcaggctctgtctccttcttcccccaagccgaaacctgcaaagtccaatctaaccgcgtcttctgcgacaccatgaacagtcttaccctcccgtcagaagtcaacctctgcaacatagatatcttcaacccaaaatacgactgcaaaatcatgacctcaaaaaccgacgtttcctcatccgttatcacctccctcggcgcaatcgtcagctgctacggcaagacaaagtgcacggcttcaaacaaaaaccgcggaatcatcaagacattcagcaacggctgcgactacgtatccaacaaaggagtggacacagtctccgttggaaacaccctctactgcgtaaacaaacaagaaggccaatcactctacgtcaaaggcgaacccatcatcaacttctacgacccactcgtcttcccctccgacgagttcgacgcctcaatcagccaagtcaacgagaaaattaaccagtcactcgccttcatacgcaaatccgacgaacttctacacaacgtaaacgtcggaaaatcaaccacaaacatcatgattaccacaattatcatagtcatcatagtaatcctcctgctactcatagcagtcggactcttcctatactgcaaagcccgctccacccctgtcaccctatccaaagaccaactttccggcatcaacaacatagccttttccaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14269 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut1 (opt1)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14270 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut1 (opt1)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14271 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut1 (opt2)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14272 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut1 (opt3)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagaccaactcagtggcattaataacatcgcattctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14273 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut1 (opt4)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14274 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut1 (opt5)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagaccaactctctgggatcaataacattgctttctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14275 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut1 (opt6)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttccaattctaaaaaccaatgctataacaacaatattagcagcagttacattatgcttcgcctcatcacaaaatatcacagaagaattttaccaatccacatgctcagcagtatctaaagggtacctaggagccctacgaacaggatggtacacatcagtaataacaatagaactctcaaacatcaaagaaaacaaatgcaatggaacagacgctaaagtaaaattaataaaacaagaactagacaaatacaaaaacgccgtcaccgaacttcagttactcatgcaaagcacacctgcagcaggatcaggttcagcaatatgctcaggaatagcagtttgcaaagtattacacctagaaggtgaagtcaacaaaataaaaaacgcacttctaagtactaacaaagctgtagtatcattatcaaacggagtatccgtactaacctttaaagtcctagacctaaaaaactacatagacaaacaactactcccaatactcaataaacaatcctgctcaattcccaacatcgaaacagtaatagaatttcaacaaaaaaacaatcgccttctagaaataacaagagaattttcagtcaacgccggagtaacaacaccagtatcaacatatatgctaacaaacagtgaactattatccttaataaacgacatgccaataacaaatgaccaaaaaaaactaatgtccaataatgtccaaatagtaagacaacaaagctattcaattatgtgtataataaaagaagaagtattagcatacgtagttcaactaccactatatggcgttatagacacaccatgctggaaattacacacaagcccactatgcacaacaaatacaaaagaaggatccaacatttgcttaactagaactgacagaggatggtactgcgacaacgctggatcagtctctttcttcccacaagcagaaacctgtaaagtacaatcaaatagagtcttctgcgacacaatgaactcactaactctcccatctgaagtaaacttatgcaacatcgatatatttaacccaaaatacgattgtaaaataatgacatccaaaacagacgtttcatcaagcgtaatcacctccctcggagcaatcgtaagctgctacggtaaaacaaaatgcacagcatccaacaaaaacagaggcatcataaaaacattctcaaacggatgtgactatgtatcaaacaaaggagtagacacagtttcagtaggcaataccttatactgtgtcaataaacaagaaggacaatcactatatgtaaaaggagaacctataataaacttctacgaccccctcgtcttccctagcgatgaatttgacgcatcaatatcgcaagtaaacgaaaaaataaaccaatcattagcctttataagaaaatcagacgaattattacacaacgtaaacgtggggaaaagcacaactaacatcatgataacaactatcataattgtaatcatcgtcatcctattactcctaatcgcagtaggactattcctatactgcaaagctagatcaacaccagtcaccctatcgaaagatcaattgtcaggaataaacaatatagccttttcaaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14276 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut1 (opt11)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatcctcaaaacgaacgccatcacaaccatcctcgccgccgtcaccctctgcttcgcgtcatcccaaaacataactgaagagttctatcaatcaacctgctccgcagtctcaaaaggctacctcggcgccctacggaccggctggtacacaagcgtcatcacaatagaactttccaacatcaaagaaaacaaatgtaacggcaccgacgcaaaagtcaaactcataaaacaagaactagacaaatataaaaacgccgtaactgaactacaactcctcatgcaatcaactcctgcagccggtagcggctccgcaatctgctcaggcatcgcagtctgcaaagtcttacacctagaaggcgaagtcaacaaaatcaagaacgccctactatccacaaacaaagcagtagtctctctatccaacggagtctccgtcctcacattcaaagtactcgacctaaagaactacatcgacaaacaactactaccaatcttaaacaaacaatcctgctcaatccctaacattgaaaccgtcatagagttccaacagaaaaacaaccgcctcctcgaaataaccagagagttctcagtcaacgccggcgtcaccaccccggtctcaacctacatgctaaccaactctgaacttctcagcctaatcaacgacatgcccattaccaacgaccaaaagaaactcatgtccaataacgtccaaatcgttcgacaacaatcctactcaatcatgtgcatcataaaagaagaagtcctagcatacgtcgtccaactcccactatacggcgtaatcgacaccccctgctggaaactccacacctcccctctctgtaccaccaacaccaaagaagggtccaacatctgcctcacgcgcaccgaccgaggctggtattgcgacaatgcaggctctgtctccttcttcccccaagccgaaacctgcaaagtccaatctaaccgcgtcttctgcgacaccatgaacagtcttaccctcccgtcagaagtcaacctctgcaacatagatatcttcaacccaaaatacgactgcaaaatcatgacctcaaaaaccgacgtttcctcatccgttatcacctccctcggcgcaatcgtcagctgctacggcaagacaaagtgcacggcttcaaacaaaaaccgcggaatcatcaagacattcagcaacggctgcgactacgtatccaacaaaggagtggacacagtctccgttggaaacaccctctactgcgtaaacaaacaagaaggccaatcactctacgtcaaaggcgaacccatcatcaacttctacgacccactcgtcttcccctccgacgagttcgacgcctcaatcagccaagtcaacgagaaaattaaccagtcactcgccttcatacgcaaatccgacgaacttctacacaacgtaaacgtcggaaaatcaaccacaaacatcatgattaccacaattatcatagtcatcatagtaatcctcctgctactcatagcagtcggactcttcctatactgcaaagcccgctccacccctgtcaccctatccaaagaccaactttccggcatcaacaacatagccttttccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14277 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut1 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14278 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut1 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14279 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut1 (opt2)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14280 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut1 (opt3)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagaccaactcagtggcattaataacatcgcattctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14281 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut1 (opt4)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14282 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut1 (opt5)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagaccaactctctgggatcaataacattgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14283 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut1 (opt6)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttccaattctaaaaaccaatgctataacaacaatattagcagcagttacattatgcttcgcctcatcacaaaatatcacagaagaattttaccaatccacatgctcagcagtatctaaagggtacctaggagccctacgaacaggatggtacacatcagtaataacaatagaactctcaaacatcaaagaaaacaaatgcaatggaacagacgctaaagtaaaattaataaaacaagaactagacaaatacaaaaacgccgtcaccgaacttcagttactcatgcaaagcacacctgcagcaggatcaggttcagcaatatgctcaggaatagcagtttgcaaagtattacacctagaaggtgaagtcaacaaaataaaaaacgcacttctaagtactaacaaagctgtagtatcattatcaaacggagtatccgtactaacctttaaagtcctagacctaaaaaactacatagacaaacaactactcccaatactcaataaacaatcctgctcaattcccaacatcgaaacagtaatagaatttcaacaaaaaaacaatcgccttctagaaataacaagagaattttcagtcaacgccggagtaacaacaccagtatcaacatatatgctaacaaacagtgaactattatccttaataaacgacatgccaataacaaatgaccaaaaaaaactaatgtccaataatgtccaaatagtaagacaacaaagctattcaattatgtgtataataaaagaagaagtattagcatacgtagttcaactaccactatatggcgttatagacacaccatgctggaaattacacacaagcccactatgcacaacaaatacaaaagaaggatccaacatttgcttaactagaactgacagaggatggtactgcgacaacgctggatcagtctctttcttcccacaagcagaaacctgtaaagtacaatcaaatagagtcttctgcgacacaatgaactcactaactctcccatctgaagtaaacttatgcaacatcgatatatttaacccaaaatacgattgtaaaataatgacatccaaaacagacgtttcatcaagcgtaatcacctccctcggagcaatcgtaagctgctacggtaaaacaaaatgcacagcatccaacaaaaacagaggcatcataaaaacattctcaaacggatgtgactatgtatcaaacaaaggagtagacacagtttcagtaggcaataccttatactgtgtcaataaacaagaaggacaatcactatatgtaaaaggagaacctataataaacttctacgaccccctcgtcttccctagcgatgaatttgacgcatcaatatcgcaagtaaacgaaaaaataaaccaatcattagcctttataagaaaatcagacgaattattacacaacgtaaacgtggggaaaagcacaactaacatcatgataacaactatcataattgtaatcatcgtcatcctattactcctaatcgcagtaggactattcctatactgcaaagctagatcaacaccagtcaccctatcgaaagatcaattgtcaggaataaacaatatagccttttcaaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14284 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut1 (opt11)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatcctcaaaacgaacgccatcacaaccatcctcgccgccgtcaccctctgcttcgcgtcatcccaaaacataactgaagagttctatcaatcaacctgctccgcagtctcaaaaggctacctcggcgccctacggaccggctggtacacaagcgtcatcacaatagaactttccaacatcaaagaaaacaaatgtaacggcaccgacgcaaaagtcaaactcataaaacaagaactagacaaatataaaaacgccgtaactgaactacaactcctcatgcaatcaactcctgcagccggtagcggctccgcaatctgctcaggcatcgcagtctgcaaagtcttacacctagaaggcgaagtcaacaaaatcaagaacgccctactatccacaaacaaagcagtagtctctctatccaacggagtctccgtcctcacattcaaagtactcgacctaaagaactacatcgacaaacaactactaccaatcttaaacaaacaatcctgctcaatccctaacattgaaaccgtcatagagttccaacagaaaaacaaccgcctcctcgaaataaccagagagttctcagtcaacgccggcgtcaccaccccggtctcaacctacatgctaaccaactctgaacttctcagcctaatcaacgacatgcccattaccaacgaccaaaagaaactcatgtccaataacgtccaaatcgttcgacaacaatcctactcaatcatgtgcatcataaaagaagaagtcctagcatacgtcgtccaactcccactatacggcgtaatcgacaccccctgctggaaactccacacctcccctctctgtaccaccaacaccaaagaagggtccaacatctgcctcacgcgcaccgaccgaggctggtattgcgacaatgcaggctctgtctccttcttcccccaagccgaaacctgcaaagtccaatctaaccgcgtcttctgcgacaccatgaacagtcttaccctcccgtcagaagtcaacctctgcaacatagatatcttcaacccaaaatacgactgcaaaatcatgacctcaaaaaccgacgtttcctcatccgttatcacctccctcggcgcaatcgtcagctgctacggcaagacaaagtgcacggcttcaaacaaaaaccgcggaatcatcaagacattcagcaacggctgcgactacgtatccaacaaaggagtggacacagtctccgttggaaacaccctctactgcgtaaacaaacaagaaggccaatcactctacgtcaaaggcgaacccatcatcaacttctacgacccactcgtcttcccctccgacgagttcgacgcctcaatcagccaagtcaacgagaaaattaaccagtcactcgccttcatacgcaaatccgacgaacttctacacaacgtaaacgtcggaaaatcaaccacaaacatcatgattaccacaattatcatagtcatcatagtaatcctcctgctactcatagcagtcggactcttcctatactgcaaagcccgctccacccctgtcaccctatccaaagaccaactttccggcatcaacaacatagccttttccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14285 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut1 (opt1)
  source 1..1994: mol_type = other RNA
gggagaggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14286 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut1 (opt1)
  source 1..1994: mol_type = other RNA
gggagaggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14287 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut1 (opt2)
  source 1..1994: mol_type = other RNA
gggagaggcgctgcctacggaggtggcagccatctccttctcggcatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14288 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut1 (opt3)
  source 1..1994: mol_type = other RNA
gggagaggcgctgcctacggaggtggcagccatctccttctcggcatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagaccaactcagtggcattaataacatcgcattctctaattgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14289 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut1 (opt4)
  source 1..1994: mol_type = other RNA
gggagaggcgctgcctacggaggtggcagccatctccttctcggcatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14290 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut1 (opt5)
  source 1..1994: mol_type = other RNA
gggagaggcgctgcctacggaggtggcagccatctccttctcggcatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagaccaactctctgggatcaataacattgctttctccaattgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14291 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut1 (opt6)
  source 1..1994: mol_type = other RNA
gggagaggcgctgcctacggaggtggcagccatctccttctcggcatcaagcttaccatggaacttccaattctaaaaaccaatgctataacaacaatattagcagcagttacattatgcttcgcctcatcacaaaatatcacagaagaattttaccaatccacatgctcagcagtatctaaagggtacctaggagccctacgaacaggatggtacacatcagtaataacaatagaactctcaaacatcaaagaaaacaaatgcaatggaacagacgctaaagtaaaattaataaaacaagaactagacaaatacaaaaacgccgtcaccgaacttcagttactcatgcaaagcacacctgcagcaggatcaggttcagcaatatgctcaggaatagcagtttgcaaagtattacacctagaaggtgaagtcaacaaaataaaaaacgcacttctaagtactaacaaagctgtagtatcattatcaaacggagtatccgtactaacctttaaagtcctagacctaaaaaactacatagacaaacaactactcccaatactcaataaacaatcctgctcaattcccaacatcgaaacagtaatagaatttcaacaaaaaaacaatcgccttctagaaataacaagagaattttcagtcaacgccggagtaacaacaccagtatcaacatatatgctaacaaacagtgaactattatccttaataaacgacatgccaataacaaatgaccaaaaaaaactaatgtccaataatgtccaaatagtaagacaacaaagctattcaattatgtgtataataaaagaagaagtattagcatacgtagttcaactaccactatatggcgttatagacacaccatgctggaaattacacacaagcccactatgcacaacaaatacaaaagaaggatccaacatttgcttaactagaactgacagaggatggtactgcgacaacgctggatcagtctctttcttcccacaagcagaaacctgtaaagtacaatcaaatagagtcttctgcgacacaatgaactcactaactctcccatctgaagtaaacttatgcaacatcgatatatttaacccaaaatacgattgtaaaataatgacatccaaaacagacgtttcatcaagcgtaatcacctccctcggagcaatcgtaagctgctacggtaaaacaaaatgcacagcatccaacaaaaacagaggcatcataaaaacattctcaaacggatgtgactatgtatcaaacaaaggagtagacacagtttcagtaggcaataccttatactgtgtcaataaacaagaaggacaatcactatatgtaaaaggagaacctataataaacttctacgaccccctcgtcttccctagcgatgaatttgacgcatcaatatcgcaagtaaacgaaaaaataaaccaatcattagcctttataagaaaatcagacgaattattacacaacgtaaacgtggggaaaagcacaactaacatcatgataacaactatcataattgtaatcatcgtcatcctattactcctaatcgcagtaggactattcctatactgcaaagctagatcaacaccagtcaccctatcgaaagatcaattgtcaggaataaacaatatagccttttcaaattaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14292 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut1 (opt11)
  source 1..1994: mol_type = other RNA
gggagaggcgctgcctacggaggtggcagccatctccttctcggcatcaagcttaccatggaactccccatcctcaaaacgaacgccatcacaaccatcctcgccgccgtcaccctctgcttcgcgtcatcccaaaacataactgaagagttctatcaatcaacctgctccgcagtctcaaaaggctacctcggcgccctacggaccggctggtacacaagcgtcatcacaatagaactttccaacatcaaagaaaacaaatgtaacggcaccgacgcaaaagtcaaactcataaaacaagaactagacaaatataaaaacgccgtaactgaactacaactcctcatgcaatcaactcctgcagccggtagcggctccgcaatctgctcaggcatcgcagtctgcaaagtcttacacctagaaggcgaagtcaacaaaatcaagaacgccctactatccacaaacaaagcagtagtctctctatccaacggagtctccgtcctcacattcaaagtactcgacctaaagaactacatcgacaaacaactactaccaatcttaaacaaacaatcctgctcaatccctaacattgaaaccgtcatagagttccaacagaaaaacaaccgcctcctcgaaataaccagagagttctcagtcaacgccggcgtcaccaccccggtctcaacctacatgctaaccaactctgaacttctcagcctaatcaacgacatgcccattaccaacgaccaaaagaaactcatgtccaataacgtccaaatcgttcgacaacaatcctactcaatcatgtgcatcataaaagaagaagtcctagcatacgtcgtccaactcccactatacggcgtaatcgacaccccctgctggaaactccacacctcccctctctgtaccaccaacaccaaagaagggtccaacatctgcctcacgcgcaccgaccgaggctggtattgcgacaatgcaggctctgtctccttcttcccccaagccgaaacctgcaaagtccaatctaaccgcgtcttctgcgacaccatgaacagtcttaccctcccgtcagaagtcaacctctgcaacatagatatcttcaacccaaaatacgactgcaaaatcatgacctcaaaaaccgacgtttcctcatccgttatcacctccctcggcgcaatcgtcagctgctacggcaagacaaagtgcacggcttcaaacaaaaaccgcggaatcatcaagacattcagcaacggctgcgactacgtatccaacaaaggagtggacacagtctccgttggaaacaccctctactgcgtaaacaaacaagaaggccaatcactctacgtcaaaggcgaacccatcatcaacttctacgacccactcgtcttcccctccgacgagttcgacgcctcaatcagccaagtcaacgagaaaattaaccagtcactcgccttcatacgcaaatccgacgaacttctacacaacgtaaacgtcggaaaatcaaccacaaacatcatgattaccacaattatcatagtcatcatagtaatcctcctgctactcatagcagtcggactcttcctatactgcaaagcccgctccacccctgtcaccctatccaaagaccaactttccggcatcaacaacatagccttttccaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14293 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut1 (opt1)
  source 1..1990: mol_type = other RNA
ggggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14294 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut1 (opt1)
  source 1..1990: mol_type = other RNA
ggggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14295 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut1 (opt2)
  source 1..1990: mol_type = other RNA
ggggcgctgcctacggaggtggcagccatctccttctcggcatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14296 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut1 (opt3)
  source 1..1990: mol_type = other RNA
ggggcgctgcctacggaggtggcagccatctccttctcggcatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagaccaactcagtggcattaataacatcgcattctctaattgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14297 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut1 (opt4)
  source 1..1990: mol_type = other RNA
ggggcgctgcctacggaggtggcagccatctccttctcggcatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14298 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut1 (opt5)
  source 1..1990: mol_type = other RNA
ggggcgctgcctacggaggtggcagccatctccttctcggcatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagaccaactctctgggatcaataacattgctttctccaattgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14299 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut1 (opt6)
  source 1..1990: mol_type = other RNA
ggggcgctgcctacggaggtggcagccatctccttctcggcatcaagcttaccatggaacttccaattctaaaaaccaatgctataacaacaatattagcagcagttacattatgcttcgcctcatcacaaaatatcacagaagaattttaccaatccacatgctcagcagtatctaaagggtacctaggagccctacgaacaggatggtacacatcagtaataacaatagaactctcaaacatcaaagaaaacaaatgcaatggaacagacgctaaagtaaaattaataaaacaagaactagacaaatacaaaaacgccgtcaccgaacttcagttactcatgcaaagcacacctgcagcaggatcaggttcagcaatatgctcaggaatagcagtttgcaaagtattacacctagaaggtgaagtcaacaaaataaaaaacgcacttctaagtactaacaaagctgtagtatcattatcaaacggagtatccgtactaacctttaaagtcctagacctaaaaaactacatagacaaacaactactcccaatactcaataaacaatcctgctcaattcccaacatcgaaacagtaatagaatttcaacaaaaaaacaatcgccttctagaaataacaagagaattttcagtcaacgccggagtaacaacaccagtatcaacatatatgctaacaaacagtgaactattatccttaataaacgacatgccaataacaaatgaccaaaaaaaactaatgtccaataatgtccaaatagtaagacaacaaagctattcaattatgtgtataataaaagaagaagtattagcatacgtagttcaactaccactatatggcgttatagacacaccatgctggaaattacacacaagcccactatgcacaacaaatacaaaagaaggatccaacatttgcttaactagaactgacagaggatggtactgcgacaacgctggatcagtctctttcttcccacaagcagaaacctgtaaagtacaatcaaatagagtcttctgcgacacaatgaactcactaactctcccatctgaagtaaacttatgcaacatcgatatatttaacccaaaatacgattgtaaaataatgacatccaaaacagacgtttcatcaagcgtaatcacctccctcggagcaatcgtaagctgctacggtaaaacaaaatgcacagcatccaacaaaaacagaggcatcataaaaacattctcaaacggatgtgactatgtatcaaacaaaggagtagacacagtttcagtaggcaataccttatactgtgtcaataaacaagaaggacaatcactatatgtaaaaggagaacctataataaacttctacgaccccctcgtcttccctagcgatgaatttgacgcatcaatatcgcaagtaaacgaaaaaataaaccaatcattagcctttataagaaaatcagacgaattattacacaacgtaaacgtggggaaaagcacaactaacatcatgataacaactatcataattgtaatcatcgtcatcctattactcctaatcgcagtaggactattcctatactgcaaagctagatcaacaccagtcaccctatcgaaagatcaattgtcaggaataaacaatatagccttttcaaattaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14300 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut1 (opt11)
  source 1..1990: mol_type = other RNA
ggggcgctgcctacggaggtggcagccatctccttctcggcatcaagcttaccatggaactccccatcctcaaaacgaacgccatcacaaccatcctcgccgccgtcaccctctgcttcgcgtcatcccaaaacataactgaagagttctatcaatcaacctgctccgcagtctcaaaaggctacctcggcgccctacggaccggctggtacacaagcgtcatcacaatagaactttccaacatcaaagaaaacaaatgtaacggcaccgacgcaaaagtcaaactcataaaacaagaactagacaaatataaaaacgccgtaactgaactacaactcctcatgcaatcaactcctgcagccggtagcggctccgcaatctgctcaggcatcgcagtctgcaaagtcttacacctagaaggcgaagtcaacaaaatcaagaacgccctactatccacaaacaaagcagtagtctctctatccaacggagtctccgtcctcacattcaaagtactcgacctaaagaactacatcgacaaacaactactaccaatcttaaacaaacaatcctgctcaatccctaacattgaaaccgtcatagagttccaacagaaaaacaaccgcctcctcgaaataaccagagagttctcagtcaacgccggcgtcaccaccccggtctcaacctacatgctaaccaactctgaacttctcagcctaatcaacgacatgcccattaccaacgaccaaaagaaactcatgtccaataacgtccaaatcgttcgacaacaatcctactcaatcatgtgcatcataaaagaagaagtcctagcatacgtcgtccaactcccactatacggcgtaatcgacaccccctgctggaaactccacacctcccctctctgtaccaccaacaccaaagaagggtccaacatctgcctcacgcgcaccgaccgaggctggtattgcgacaatgcaggctctgtctccttcttcccccaagccgaaacctgcaaagtccaatctaaccgcgtcttctgcgacaccatgaacagtcttaccctcccgtcagaagtcaacctctgcaacatagatatcttcaacccaaaatacgactgcaaaatcatgacctcaaaaaccgacgtttcctcatccgttatcacctccctcggcgcaatcgtcagctgctacggcaagacaaagtgcacggcttcaaacaaaaaccgcggaatcatcaagacattcagcaacggctgcgactacgtatccaacaaaggagtggacacagtctccgttggaaacaccctctactgcgtaaacaaacaagaaggccaatcactctacgtcaaaggcgaacccatcatcaacttctacgacccactcgtcttcccctccgacgagttcgacgcctcaatcagccaagtcaacgagaaaattaaccagtcactcgccttcatacgcaaatccgacgaacttctacacaacgtaaacgtcggaaaatcaaccacaaacatcatgattaccacaattatcatagtcatcatagtaatcctcctgctactcatagcagtcggactcttcctatactgcaaagcccgctccacccctgtcaccctatccaaagaccaactttccggcatcaacaacatagccttttccaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14301 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut1 (opt1)
  source 1..1825: mol_type = other RNA
gggagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14302 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut1 (opt1)
  source 1..1825: mol_type = other RNA
gggagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14303 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut1 (opt2)
  source 1..1825: mol_type = other RNA
gggagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14304 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut1 (opt3)
  source 1..1825: mol_type = other RNA
gggagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagaccaactcagtggcattaataacatcgcattctctaattgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14305 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut1 (opt4)
  source 1..1825: mol_type = other RNA
gggagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14306 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut1 (opt5)
  source 1..1825: mol_type = other RNA
gggagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagaccaactctctgggatcaataacattgctttctccaattgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14307 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut1 (opt6)
  source 1..1825: mol_type = other RNA
gggagaaagcttaccatggaacttccaattctaaaaaccaatgctataacaacaatattagcagcagttacattatgcttcgcctcatcacaaaatatcacagaagaattttaccaatccacatgctcagcagtatctaaagggtacctaggagccctacgaacaggatggtacacatcagtaataacaatagaactctcaaacatcaaagaaaacaaatgcaatggaacagacgctaaagtaaaattaataaaacaagaactagacaaatacaaaaacgccgtcaccgaacttcagttactcatgcaaagcacacctgcagcaggatcaggttcagcaatatgctcaggaatagcagtttgcaaagtattacacctagaaggtgaagtcaacaaaataaaaaacgcacttctaagtactaacaaagctgtagtatcattatcaaacggagtatccgtactaacctttaaagtcctagacctaaaaaactacatagacaaacaactactcccaatactcaataaacaatcctgctcaattcccaacatcgaaacagtaatagaatttcaacaaaaaaacaatcgccttctagaaataacaagagaattttcagtcaacgccggagtaacaacaccagtatcaacatatatgctaacaaacagtgaactattatccttaataaacgacatgccaataacaaatgaccaaaaaaaactaatgtccaataatgtccaaatagtaagacaacaaagctattcaattatgtgtataataaaagaagaagtattagcatacgtagttcaactaccactatatggcgttatagacacaccatgctggaaattacacacaagcccactatgcacaacaaatacaaaagaaggatccaacatttgcttaactagaactgacagaggatggtactgcgacaacgctggatcagtctctttcttcccacaagcagaaacctgtaaagtacaatcaaatagagtcttctgcgacacaatgaactcactaactctcccatctgaagtaaacttatgcaacatcgatatatttaacccaaaatacgattgtaaaataatgacatccaaaacagacgtttcatcaagcgtaatcacctccctcggagcaatcgtaagctgctacggtaaaacaaaatgcacagcatccaacaaaaacagaggcatcataaaaacattctcaaacggatgtgactatgtatcaaacaaaggagtagacacagtttcagtaggcaataccttatactgtgtcaataaacaagaaggacaatcactatatgtaaaaggagaacctataataaacttctacgaccccctcgtcttccctagcgatgaatttgacgcatcaatatcgcaagtaaacgaaaaaataaaccaatcattagcctttataagaaaatcagacgaattattacacaacgtaaacgtggggaaaagcacaactaacatcatgataacaactatcataattgtaatcatcgtcatcctattactcctaatcgcagtaggactattcctatactgcaaagctagatcaacaccagtcaccctatcgaaagatcaattgtcaggaataaacaatatagccttttcaaattaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14308 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut1 (opt11)
  source 1..1825: mol_type = other RNA
gggagaaagcttaccatggaactccccatcctcaaaacgaacgccatcacaaccatcctcgccgccgtcaccctctgcttcgcgtcatcccaaaacataactgaagagttctatcaatcaacctgctccgcagtctcaaaaggctacctcggcgccctacggaccggctggtacacaagcgtcatcacaatagaactttccaacatcaaagaaaacaaatgtaacggcaccgacgcaaaagtcaaactcataaaacaagaactagacaaatataaaaacgccgtaactgaactacaactcctcatgcaatcaactcctgcagccggtagcggctccgcaatctgctcaggcatcgcagtctgcaaagtcttacacctagaaggcgaagtcaacaaaatcaagaacgccctactatccacaaacaaagcagtagtctctctatccaacggagtctccgtcctcacattcaaagtactcgacctaaagaactacatcgacaaacaactactaccaatcttaaacaaacaatcctgctcaatccctaacattgaaaccgtcatagagttccaacagaaaaacaaccgcctcctcgaaataaccagagagttctcagtcaacgccggcgtcaccaccccggtctcaacctacatgctaaccaactctgaacttctcagcctaatcaacgacatgcccattaccaacgaccaaaagaaactcatgtccaataacgtccaaatcgttcgacaacaatcctactcaatcatgtgcatcataaaagaagaagtcctagcatacgtcgtccaactcccactatacggcgtaatcgacaccccctgctggaaactccacacctcccctctctgtaccaccaacaccaaagaagggtccaacatctgcctcacgcgcaccgaccgaggctggtattgcgacaatgcaggctctgtctccttcttcccccaagccgaaacctgcaaagtccaatctaaccgcgtcttctgcgacaccatgaacagtcttaccctcccgtcagaagtcaacctctgcaacatagatatcttcaacccaaaatacgactgcaaaatcatgacctcaaaaaccgacgtttcctcatccgttatcacctccctcggcgcaatcgtcagctgctacggcaagacaaagtgcacggcttcaaacaaaaaccgcggaatcatcaagacattcagcaacggctgcgactacgtatccaacaaaggagtggacacagtctccgttggaaacaccctctactgcgtaaacaaacaagaaggccaatcactctacgtcaaaggcgaacccatcatcaacttctacgacccactcgtcttcccctccgacgagttcgacgcctcaatcagccaagtcaacgagaaaattaaccagtcactcgccttcatacgcaaatccgacgaacttctacacaacgtaaacgtcggaaaatcaaccacaaacatcatgattaccacaattatcatagtcatcatagtaatcctcctgctactcatagcagtcggactcttcctatactgcaaagcccgctccacccctgtcaccctatccaaagaccaactttccggcatcaacaacatagccttttccaactaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14309 - protein, 514 aa, synthetic construct
  REGION 1..514: note = derived and/or modified protein sequence (artificial) from HRSV(Memphis-37)__AIY60640.1__F-del_DSCav1_mut1
MELPILKTNAITTILAAVTLCFASSQNITEEFYQSTCSAVSKGYLGALRTGWYTSVITIELSNIKENKCNGTDAKVKLIKQELDKYKNAVTELQLLMQSTPAAGSGSAICSGIAVCKVLHLEGEVNKIKNALLSTNKAVVSLSNGVSVLTFKVLDLKNYIDKQLLPILNKQSCSIPNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYCVNKQEGQSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 14310 - RNA, 1545 nt, synthetic construct
  misc_feature 1..1545: note = derived and/or modified CDS sequence (opt1) from HRSV(Memphis-37)__AIY60640.1__F-del_DSCav1_mut1
  source 1..1545: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctga

SEQ ID NO: 14311 - RNA, 1545 nt, synthetic construct
  misc_feature 1..1545: note = derived and/or modified CDS sequence (opt1) from HRSV(Memphis-37)__AIY60640.1__F-del_DSCav1_mut1
  source 1..1545: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtga

SEQ ID NO: 14312 - RNA, 1545 nt, synthetic construct
  misc_feature 1..1545: note = derived and/or modified CDS sequence (opt2) from HRSV(Memphis-37)__AIY60640.1__F-del_DSCav1_mut1
  source 1..1545: mol_type = other RNA
atggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctga

SEQ ID NO: 14313 - RNA, 1545 nt, synthetic construct
  misc_feature 1..1545: note = derived and/or modified CDS sequence (opt3) from HRSV(Memphis-37)__AIY60640.1__F-del_DSCav1_mut1
  source 1..1545: mol_type = other RNA
atggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctga

SEQ ID NO: 14314 - RNA, 1545 nt, synthetic construct
  misc_feature 1..1545: note = derived and/or modified CDS sequence (opt4) from HRSV(Memphis-37)__AIY60640.1__F-del_DSCav1_mut1
  source 1..1545: mol_type = other RNA
atggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatga

SEQ ID NO: 14315 - RNA, 1545 nt, synthetic construct
  misc_feature 1..1545: note = derived and/or modified CDS sequence (opt5) from HRSV(Memphis-37)__AIY60640.1__F-del_DSCav1_mut1
  source 1..1545: mol_type = other RNA
atggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatga

SEQ ID NO: 14316 - RNA, 1545 nt, synthetic construct
  misc_feature 1..1545: note = derived and/or modified CDS sequence (opt6) from HRSV(Memphis-37)__AIY60640.1__F-del_DSCav1_mut1
  source 1..1545: mol_type = other RNA
atggaattaccaatactaaaaacaaacgcaataacaacaattctagcagcagtaacattatgctttgcatcatcccaaaacatcacagaagaattttatcaatcaacctgctcagcagtttccaaaggatacttaggagcattaagaactggttggtacacttcagtaatcaccatcgaactctcaaacatcaaggaaaacaaatgcaacggaacagacgcaaaagttaaactcataaaacaagaacttgacaaatacaaaaacgccgtaacagaactacaacttctcatgcaatcaacacccgcagcaggatccggatcagccatatgctcaggcatagcagtatgtaaagtattacatcttgaaggtgaagtaaacaaaataaaaaacgcacttctatcaaccaacaaagcagtagtatcactatcaaacggagtatccgtcttaacatttaaagttctagacctcaaaaactatatagacaaacaattactgccaatcctcaataaacaatcatgctcaataccaaacatcgaaacagtaatagaatttcaacaaaaaaacaacagactactagaaataacaagagaattttccgtcaacgccggcgtaactactccagtatcaacatatatgctaaccaactcagaactcctatccctcataaacgacatgccaataactaatgatcaaaaaaaactaatgtcaaacaatgtacaaatagttagacaacaatcatactcaatcatgtgcataataaaagaagaagtactagcatacgtcgtccaactacccctatacggagtaatagacacaccttgctggaaactacacacatcacccctatgcacaacaaatacaaaagaaggttccaacatctgcctaacaagaactgatagaggatggtactgcgacaacgccggatcagtatcattcttccctcaagctgaaacctgcaaagtacaatcaaacagagtattttgcgatacaatgaactccctaacacttccctcagaagttaatctttgtaatatagatatattcaacccaaaatacgactgcaaaataatgacaagtaaaacagacgtatcctcatctgtaattacatcactaggagccatagtatcttgctacggcaaaaccaaatgcacagcatcaaacaaaaacagaggtattatcaaaaccttctcaaacggatgtgactacgtttcaaacaaaggagtagacacagtatcagtcggaaacaccctatactgtgttaacaaacaagaaggacaatcactgtacgtaaaaggagaacccataataaatttctacgacccacttgtatttccatcagacgaatttgatgcatcaatctcacaagtaaatgaaaaaataaaccaatcattagcattcataagaaaatctgacgagttactacacaacgtaaatgttggcaaatcaacaaccaatataatgataacaacaataataatagtaataatagtcatattactcctcctcatagccgtcggattattcttatactgcaaagcaagataa

SEQ ID NO: 14317 - RNA, 1545 nt, synthetic construct
  misc_feature 1..1545: note = derived and/or modified CDS sequence (opt11) from HRSV(Memphis-37)__AIY60640.1__F-del_DSCav1_mut1
  source 1..1545: mol_type = other RNA
atggaactccccatactaaaaaccaacgccatcacaacaatcctcgccgccgtcacactctgcttcgccagctcccaaaacatcaccgaagagttctatcaatcaacctgctccgcagtctcaaagggatacctcggagccctccgcaccggatggtacacttccgtcatcacaatagaactctccaacatcaaagaaaacaaatgcaacggcaccgacgcaaaagtcaagctcatcaaacaagaactcgacaaatataaaaacgccgtcaccgaactccaactactcatgcaatccacacccgcggccggctcaggcagcgccatctgctcaggcatcgccgtctgcaaagtcctccacctcgaaggcgaagtcaacaaaatcaaaaacgcccttctttcaaccaacaaggcagtagtatccctctcaaacggcgtcagcgtcctgaccttcaaagtcctagacctcaaaaactacatagataaacaactcctccccatactgaacaaacaatcgtgctccatccccaatatcgaaaccgtcatagagttccagcagaaaaacaacagacttctcgaaataacccgagagttctcagtaaacgccggagtcaccacacccgtaagcacctacatgctcacaaactcagaactcctatccctcatcaacgacatgcccatcaccaacgaccagaaaaagctaatgtccaacaacgtccaaatagtacgccaacaaagctactcgataatgtgcatcatcaaggaagaagtactcgcctacgtcgtccaactccccctctacggcgtaatcgacacaccctgctggaaactccacacgtccccactctgcacaacaaacacaaaagaaggatccaacatatgcctaacccgcaccgacaggggctggtactgcgacaacgcaggctcagtcagcttctttccccaagccgaaacatgcaaagtccaatccaaccgtgtcttctgcgacaccatgaactcgctcaccctaccctcggaagtcaatctctgcaacatcgacatcttcaacccaaaatacgactgtaaaatcatgaccagcaaaacagacgtttcttccagcgtcatcacatcactcggcgcgatcgtatcatgctatggcaaaacaaagtgcaccgctagcaataaaaaccgaggaatcataaaaaccttcagcaacggctgcgactacgtatccaacaaaggcgtcgacaccgtatccgtcggaaacaccctctactgcgtcaacaagcaagaaggacaatcactctacgtcaaaggcgaaccaatcataaacttctacgacccactcgtattcccctcagacgagttcgacgcatccatctcccaagtcaacgaaaagatcaaccaatctctcgcctttatacgcaaaagcgacgaactccttcacaacgtaaacgtcggcaaaagcaccactaacataatgatcaccacaatcataatagtaatcatcgtaatactcctcctactcatcgccgtgggcctattcctctattgcaaagcccgataa

SEQ ID NO: 14318 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut1 (opt1)
  source 1..1821: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14319 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut1 (opt1)
  source 1..1821: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14320 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut1 (opt2)
  source 1..1821: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14321 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut1 (opt3)
  source 1..1821: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14322 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut1 (opt4)
  source 1..1821: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14323 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut1 (opt5)
  source 1..1821: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14324 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut1 (opt6)
  source 1..1821: mol_type = other RNA
gggagagtcccgcagtcggcgtccagcggctctgcttgttcgtgtgtgtgtcgttgcaggccttattcaagcttaccatggaattaccaatactaaaaacaaacgcaataacaacaattctagcagcagtaacattatgctttgcatcatcccaaaacatcacagaagaattttatcaatcaacctgctcagcagtttccaaaggatacttaggagcattaagaactggttggtacacttcagtaatcaccatcgaactctcaaacatcaaggaaaacaaatgcaacggaacagacgcaaaagttaaactcataaaacaagaacttgacaaatacaaaaacgccgtaacagaactacaacttctcatgcaatcaacacccgcagcaggatccggatcagccatatgctcaggcatagcagtatgtaaagtattacatcttgaaggtgaagtaaacaaaataaaaaacgcacttctatcaaccaacaaagcagtagtatcactatcaaacggagtatccgtcttaacatttaaagttctagacctcaaaaactatatagacaaacaattactgccaatcctcaataaacaatcatgctcaataccaaacatcgaaacagtaatagaatttcaacaaaaaaacaacagactactagaaataacaagagaattttccgtcaacgccggcgtaactactccagtatcaacatatatgctaaccaactcagaactcctatccctcataaacgacatgccaataactaatgatcaaaaaaaactaatgtcaaacaatgtacaaatagttagacaacaatcatactcaatcatgtgcataataaaagaagaagtactagcatacgtcgtccaactacccctatacggagtaatagacacaccttgctggaaactacacacatcacccctatgcacaacaaatacaaaagaaggttccaacatctgcctaacaagaactgatagaggatggtactgcgacaacgccggatcagtatcattcttccctcaagctgaaacctgcaaagtacaatcaaacagagtattttgcgatacaatgaactccctaacacttccctcagaagttaatctttgtaatatagatatattcaacccaaaatacgactgcaaaataatgacaagtaaaacagacgtatcctcatctgtaattacatcactaggagccatagtatcttgctacggcaaaaccaaatgcacagcatcaaacaaaaacagaggtattatcaaaaccttctcaaacggatgtgactacgtttcaaacaaaggagtagacacagtatcagtcggaaacaccctatactgtgttaacaaacaagaaggacaatcactgtacgtaaaaggagaacccataataaatttctacgacccacttgtatttccatcagacgaatttgatgcatcaatctcacaagtaaatgaaaaaataaaccaatcattagcattcataagaaaatctgacgagttactacacaacgtaaatgttggcaaatcaacaaccaatataatgataacaacaataataatagtaataatagtcatattactcctcctcatagccgtcggattattcttatactgcaaagcaagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14325 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut1 (opt11)
  source 1..1821: mol_type = other RNA
gggagagtcccgcagtcggcgtccagcggctctgcttgttcgtgtgtgtgtcgttgcaggccttattcaagcttaccatggaactccccatactaaaaaccaacgccatcacaacaatcctcgccgccgtcacactctgcttcgccagctcccaaaacatcaccgaagagttctatcaatcaacctgctccgcagtctcaaagggatacctcggagccctccgcaccggatggtacacttccgtcatcacaatagaactctccaacatcaaagaaaacaaatgcaacggcaccgacgcaaaagtcaagctcatcaaacaagaactcgacaaatataaaaacgccgtcaccgaactccaactactcatgcaatccacacccgcggccggctcaggcagcgccatctgctcaggcatcgccgtctgcaaagtcctccacctcgaaggcgaagtcaacaaaatcaaaaacgcccttctttcaaccaacaaggcagtagtatccctctcaaacggcgtcagcgtcctgaccttcaaagtcctagacctcaaaaactacatagataaacaactcctccccatactgaacaaacaatcgtgctccatccccaatatcgaaaccgtcatagagttccagcagaaaaacaacagacttctcgaaataacccgagagttctcagtaaacgccggagtcaccacacccgtaagcacctacatgctcacaaactcagaactcctatccctcatcaacgacatgcccatcaccaacgaccagaaaaagctaatgtccaacaacgtccaaatagtacgccaacaaagctactcgataatgtgcatcatcaaggaagaagtactcgcctacgtcgtccaactccccctctacggcgtaatcgacacaccctgctggaaactccacacgtccccactctgcacaacaaacacaaaagaaggatccaacatatgcctaacccgcaccgacaggggctggtactgcgacaacgcaggctcagtcagcttctttccccaagccgaaacatgcaaagtccaatccaaccgtgtcttctgcgacaccatgaactcgctcaccctaccctcggaagtcaatctctgcaacatcgacatcttcaacccaaaatacgactgtaaaatcatgaccagcaaaacagacgtttcttccagcgtcatcacatcactcggcgcgatcgtatcatgctatggcaaaacaaagtgcaccgctagcaataaaaaccgaggaatcataaaaaccttcagcaacggctgcgactacgtatccaacaaaggcgtcgacaccgtatccgtcggaaacaccctctactgcgtcaacaagcaagaaggacaatcactctacgtcaaaggcgaaccaatcataaacttctacgacccactcgtattcccctcagacgagttcgacgcatccatctcccaagtcaacgaaaagatcaaccaatctctcgcctttatacgcaaaagcgacgaactccttcacaacgtaaacgtcggcaaaagcaccactaacataatgatcaccacaatcataatagtaatcatcgtaatactcctcctactcatcgccgtgggcctattcctctattgcaaagcccgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14326 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut1 (opt1)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14327 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut1 (opt1)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14328 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut1 (opt2)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14329 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut1 (opt3)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14330 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut1 (opt4)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14331 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut1 (opt5)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14332 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut1 (opt6)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggaattaccaatactaaaaacaaacgcaataacaacaattctagcagcagtaacattatgctttgcatcatcccaaaacatcacagaagaattttatcaatcaacctgctcagcagtttccaaaggatacttaggagcattaagaactggttggtacacttcagtaatcaccatcgaactctcaaacatcaaggaaaacaaatgcaacggaacagacgcaaaagttaaactcataaaacaagaacttgacaaatacaaaaacgccgtaacagaactacaacttctcatgcaatcaacacccgcagcaggatccggatcagccatatgctcaggcatagcagtatgtaaagtattacatcttgaaggtgaagtaaacaaaataaaaaacgcacttctatcaaccaacaaagcagtagtatcactatcaaacggagtatccgtcttaacatttaaagttctagacctcaaaaactatatagacaaacaattactgccaatcctcaataaacaatcatgctcaataccaaacatcgaaacagtaatagaatttcaacaaaaaaacaacagactactagaaataacaagagaattttccgtcaacgccggcgtaactactccagtatcaacatatatgctaaccaactcagaactcctatccctcataaacgacatgccaataactaatgatcaaaaaaaactaatgtcaaacaatgtacaaatagttagacaacaatcatactcaatcatgtgcataataaaagaagaagtactagcatacgtcgtccaactacccctatacggagtaatagacacaccttgctggaaactacacacatcacccctatgcacaacaaatacaaaagaaggttccaacatctgcctaacaagaactgatagaggatggtactgcgacaacgccggatcagtatcattcttccctcaagctgaaacctgcaaagtacaatcaaacagagtattttgcgatacaatgaactccctaacacttccctcagaagttaatctttgtaatatagatatattcaacccaaaatacgactgcaaaataatgacaagtaaaacagacgtatcctcatctgtaattacatcactaggagccatagtatcttgctacggcaaaaccaaatgcacagcatcaaacaaaaacagaggtattatcaaaaccttctcaaacggatgtgactacgtttcaaacaaaggagtagacacagtatcagtcggaaacaccctatactgtgttaacaaacaagaaggacaatcactgtacgtaaaaggagaacccataataaatttctacgacccacttgtatttccatcagacgaatttgatgcatcaatctcacaagtaaatgaaaaaataaaccaatcattagcattcataagaaaatctgacgagttactacacaacgtaaatgttggcaaatcaacaaccaatataatgataacaacaataataatagtaataatagtcatattactcctcctcatagccgtcggattattcttatactgcaaagcaagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14333 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut1 (opt11)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggaactccccatactaaaaaccaacgccatcacaacaatcctcgccgccgtcacactctgcttcgccagctcccaaaacatcaccgaagagttctatcaatcaacctgctccgcagtctcaaagggatacctcggagccctccgcaccggatggtacacttccgtcatcacaatagaactctccaacatcaaagaaaacaaatgcaacggcaccgacgcaaaagtcaagctcatcaaacaagaactcgacaaatataaaaacgccgtcaccgaactccaactactcatgcaatccacacccgcggccggctcaggcagcgccatctgctcaggcatcgccgtctgcaaagtcctccacctcgaaggcgaagtcaacaaaatcaaaaacgcccttctttcaaccaacaaggcagtagtatccctctcaaacggcgtcagcgtcctgaccttcaaagtcctagacctcaaaaactacatagataaacaactcctccccatactgaacaaacaatcgtgctccatccccaatatcgaaaccgtcatagagttccagcagaaaaacaacagacttctcgaaataacccgagagttctcagtaaacgccggagtcaccacacccgtaagcacctacatgctcacaaactcagaactcctatccctcatcaacgacatgcccatcaccaacgaccagaaaaagctaatgtccaacaacgtccaaatagtacgccaacaaagctactcgataatgtgcatcatcaaggaagaagtactcgcctacgtcgtccaactccccctctacggcgtaatcgacacaccctgctggaaactccacacgtccccactctgcacaacaaacacaaaagaaggatccaacatatgcctaacccgcaccgacaggggctggtactgcgacaacgcaggctcagtcagcttctttccccaagccgaaacatgcaaagtccaatccaaccgtgtcttctgcgacaccatgaactcgctcaccctaccctcggaagtcaatctctgcaacatcgacatcttcaacccaaaatacgactgtaaaatcatgaccagcaaaacagacgtttcttccagcgtcatcacatcactcggcgcgatcgtatcatgctatggcaaaacaaagtgcaccgctagcaataaaaaccgaggaatcataaaaaccttcagcaacggctgcgactacgtatccaacaaaggcgtcgacaccgtatccgtcggaaacaccctctactgcgtcaacaagcaagaaggacaatcactctacgtcaaaggcgaaccaatcataaacttctacgacccactcgtattcccctcagacgagttcgacgcatccatctcccaagtcaacgaaaagatcaaccaatctctcgcctttatacgcaaaagcgacgaactccttcacaacgtaaacgtcggcaaaagcaccactaacataatgatcaccacaatcataatagtaatcatcgtaatactcctcctactcatcgccgtgggcctattcctctattgcaaagcccgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14334 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut1 (opt1)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14335 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut1 (opt1)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14336 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut1 (opt2)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14337 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut1 (opt3)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14338 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut1 (opt4)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14339 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut1 (opt5)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14340 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut1 (opt6)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattaccaatactaaaaacaaacgcaataacaacaattctagcagcagtaacattatgctttgcatcatcccaaaacatcacagaagaattttatcaatcaacctgctcagcagtttccaaaggatacttaggagcattaagaactggttggtacacttcagtaatcaccatcgaactctcaaacatcaaggaaaacaaatgcaacggaacagacgcaaaagttaaactcataaaacaagaacttgacaaatacaaaaacgccgtaacagaactacaacttctcatgcaatcaacacccgcagcaggatccggatcagccatatgctcaggcatagcagtatgtaaagtattacatcttgaaggtgaagtaaacaaaataaaaaacgcacttctatcaaccaacaaagcagtagtatcactatcaaacggagtatccgtcttaacatttaaagttctagacctcaaaaactatatagacaaacaattactgccaatcctcaataaacaatcatgctcaataccaaacatcgaaacagtaatagaatttcaacaaaaaaacaacagactactagaaataacaagagaattttccgtcaacgccggcgtaactactccagtatcaacatatatgctaaccaactcagaactcctatccctcataaacgacatgccaataactaatgatcaaaaaaaactaatgtcaaacaatgtacaaatagttagacaacaatcatactcaatcatgtgcataataaaagaagaagtactagcatacgtcgtccaactacccctatacggagtaatagacacaccttgctggaaactacacacatcacccctatgcacaacaaatacaaaagaaggttccaacatctgcctaacaagaactgatagaggatggtactgcgacaacgccggatcagtatcattcttccctcaagctgaaacctgcaaagtacaatcaaacagagtattttgcgatacaatgaactccctaacacttccctcagaagttaatctttgtaatatagatatattcaacccaaaatacgactgcaaaataatgacaagtaaaacagacgtatcctcatctgtaattacatcactaggagccatagtatcttgctacggcaaaaccaaatgcacagcatcaaacaaaaacagaggtattatcaaaaccttctcaaacggatgtgactacgtttcaaacaaaggagtagacacagtatcagtcggaaacaccctatactgtgttaacaaacaagaaggacaatcactgtacgtaaaaggagaacccataataaatttctacgacccacttgtatttccatcagacgaatttgatgcatcaatctcacaagtaaatgaaaaaataaaccaatcattagcattcataagaaaatctgacgagttactacacaacgtaaatgttggcaaatcaacaaccaatataatgataacaacaataataatagtaataatagtcatattactcctcctcatagccgtcggattattcttatactgcaaagcaagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14341 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut1 (opt11)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatactaaaaaccaacgccatcacaacaatcctcgccgccgtcacactctgcttcgccagctcccaaaacatcaccgaagagttctatcaatcaacctgctccgcagtctcaaagggatacctcggagccctccgcaccggatggtacacttccgtcatcacaatagaactctccaacatcaaagaaaacaaatgcaacggcaccgacgcaaaagtcaagctcatcaaacaagaactcgacaaatataaaaacgccgtcaccgaactccaactactcatgcaatccacacccgcggccggctcaggcagcgccatctgctcaggcatcgccgtctgcaaagtcctccacctcgaaggcgaagtcaacaaaatcaaaaacgcccttctttcaaccaacaaggcagtagtatccctctcaaacggcgtcagcgtcctgaccttcaaagtcctagacctcaaaaactacatagataaacaactcctccccatactgaacaaacaatcgtgctccatccccaatatcgaaaccgtcatagagttccagcagaaaaacaacagacttctcgaaataacccgagagttctcagtaaacgccggagtcaccacacccgtaagcacctacatgctcacaaactcagaactcctatccctcatcaacgacatgcccatcaccaacgaccagaaaaagctaatgtccaacaacgtccaaatagtacgccaacaaagctactcgataatgtgcatcatcaaggaagaagtactcgcctacgtcgtccaactccccctctacggcgtaatcgacacaccctgctggaaactccacacgtccccactctgcacaacaaacacaaaagaaggatccaacatatgcctaacccgcaccgacaggggctggtactgcgacaacgcaggctcagtcagcttctttccccaagccgaaacatgcaaagtccaatccaaccgtgtcttctgcgacaccatgaactcgctcaccctaccctcggaagtcaatctctgcaacatcgacatcttcaacccaaaatacgactgtaaaatcatgaccagcaaaacagacgtttcttccagcgtcatcacatcactcggcgcgatcgtatcatgctatggcaaaacaaagtgcaccgctagcaataaaaaccgaggaatcataaaaaccttcagcaacggctgcgactacgtatccaacaaaggcgtcgacaccgtatccgtcggaaacaccctctactgcgtcaacaagcaagaaggacaatcactctacgtcaaaggcgaaccaatcataaacttctacgacccactcgtattcccctcagacgagttcgacgcatccatctcccaagtcaacgaaaagatcaaccaatctctcgcctttatacgcaaaagcgacgaactccttcacaacgtaaacgtcggcaaaagcaccactaacataatgatcaccacaatcataatagtaatcatcgtaatactcctcctactcatcgccgtgggcctattcctctattgcaaagcccgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14342 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut1 (opt1)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14343 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut1 (opt1)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14344 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut1 (opt2)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14345 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut1 (opt3)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14346 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut1 (opt4)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14347 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut1 (opt5)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14348 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut1 (opt6)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattaccaatactaaaaacaaacgcaataacaacaattctagcagcagtaacattatgctttgcatcatcccaaaacatcacagaagaattttatcaatcaacctgctcagcagtttccaaaggatacttaggagcattaagaactggttggtacacttcagtaatcaccatcgaactctcaaacatcaaggaaaacaaatgcaacggaacagacgcaaaagttaaactcataaaacaagaacttgacaaatacaaaaacgccgtaacagaactacaacttctcatgcaatcaacacccgcagcaggatccggatcagccatatgctcaggcatagcagtatgtaaagtattacatcttgaaggtgaagtaaacaaaataaaaaacgcacttctatcaaccaacaaagcagtagtatcactatcaaacggagtatccgtcttaacatttaaagttctagacctcaaaaactatatagacaaacaattactgccaatcctcaataaacaatcatgctcaataccaaacatcgaaacagtaatagaatttcaacaaaaaaacaacagactactagaaataacaagagaattttccgtcaacgccggcgtaactactccagtatcaacatatatgctaaccaactcagaactcctatccctcataaacgacatgccaataactaatgatcaaaaaaaactaatgtcaaacaatgtacaaatagttagacaacaatcatactcaatcatgtgcataataaaagaagaagtactagcatacgtcgtccaactacccctatacggagtaatagacacaccttgctggaaactacacacatcacccctatgcacaacaaatacaaaagaaggttccaacatctgcctaacaagaactgatagaggatggtactgcgacaacgccggatcagtatcattcttccctcaagctgaaacctgcaaagtacaatcaaacagagtattttgcgatacaatgaactccctaacacttccctcagaagttaatctttgtaatatagatatattcaacccaaaatacgactgcaaaataatgacaagtaaaacagacgtatcctcatctgtaattacatcactaggagccatagtatcttgctacggcaaaaccaaatgcacagcatcaaacaaaaacagaggtattatcaaaaccttctcaaacggatgtgactacgtttcaaacaaaggagtagacacagtatcagtcggaaacaccctatactgtgttaacaaacaagaaggacaatcactgtacgtaaaaggagaacccataataaatttctacgacccacttgtatttccatcagacgaatttgatgcatcaatctcacaagtaaatgaaaaaataaaccaatcattagcattcataagaaaatctgacgagttactacacaacgtaaatgttggcaaatcaacaaccaatataatgataacaacaataataatagtaataatagtcatattactcctcctcatagccgtcggattattcttatactgcaaagcaagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14349 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut1 (opt11)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactccccatactaaaaaccaacgccatcacaacaatcctcgccgccgtcacactctgcttcgccagctcccaaaacatcaccgaagagttctatcaatcaacctgctccgcagtctcaaagggatacctcggagccctccgcaccggatggtacacttccgtcatcacaatagaactctccaacatcaaagaaaacaaatgcaacggcaccgacgcaaaagtcaagctcatcaaacaagaactcgacaaatataaaaacgccgtcaccgaactccaactactcatgcaatccacacccgcggccggctcaggcagcgccatctgctcaggcatcgccgtctgcaaagtcctccacctcgaaggcgaagtcaacaaaatcaaaaacgcccttctttcaaccaacaaggcagtagtatccctctcaaacggcgtcagcgtcctgaccttcaaagtcctagacctcaaaaactacatagataaacaactcctccccatactgaacaaacaatcgtgctccatccccaatatcgaaaccgtcatagagttccagcagaaaaacaacagacttctcgaaataacccgagagttctcagtaaacgccggagtcaccacacccgtaagcacctacatgctcacaaactcagaactcctatccctcatcaacgacatgcccatcaccaacgaccagaaaaagctaatgtccaacaacgtccaaatagtacgccaacaaagctactcgataatgtgcatcatcaaggaagaagtactcgcctacgtcgtccaactccccctctacggcgtaatcgacacaccctgctggaaactccacacgtccccactctgcacaacaaacacaaaagaaggatccaacatatgcctaacccgcaccgacaggggctggtactgcgacaacgcaggctcagtcagcttctttccccaagccgaaacatgcaaagtccaatccaaccgtgtcttctgcgacaccatgaactcgctcaccctaccctcggaagtcaatctctgcaacatcgacatcttcaacccaaaatacgactgtaaaatcatgaccagcaaaacagacgtttcttccagcgtcatcacatcactcggcgcgatcgtatcatgctatggcaaaacaaagtgcaccgctagcaataaaaaccgaggaatcataaaaaccttcagcaacggctgcgactacgtatccaacaaaggcgtcgacaccgtatccgtcggaaacaccctctactgcgtcaacaagcaagaaggacaatcactctacgtcaaaggcgaaccaatcataaacttctacgacccactcgtattcccctcagacgagttcgacgcatccatctcccaagtcaacgaaaagatcaaccaatctctcgcctttatacgcaaaagcgacgaactccttcacaacgtaaacgtcggcaaaagcaccactaacataatgatcaccacaatcataatagtaatcatcgtaatactcctcctactcatcgccgtgggcctattcctctattgcaaagcccgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14350 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut1 (opt1)
  source 1..1813: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14351 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut1 (opt1)
  source 1..1813: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14352 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut1 (opt2)
  source 1..1813: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14353 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut1 (opt3)
  source 1..1813: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14354 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut1 (opt4)
  source 1..1813: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14355 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut1 (opt5)
  source 1..1813: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14356 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut1 (opt6)
  source 1..1813: mol_type = other RNA
gggagactttcccattctgtagcagaatttggtgttgcctgtggtcttggtcccgcggagaagcttaccatggaattaccaatactaaaaacaaacgcaataacaacaattctagcagcagtaacattatgctttgcatcatcccaaaacatcacagaagaattttatcaatcaacctgctcagcagtttccaaaggatacttaggagcattaagaactggttggtacacttcagtaatcaccatcgaactctcaaacatcaaggaaaacaaatgcaacggaacagacgcaaaagttaaactcataaaacaagaacttgacaaatacaaaaacgccgtaacagaactacaacttctcatgcaatcaacacccgcagcaggatccggatcagccatatgctcaggcatagcagtatgtaaagtattacatcttgaaggtgaagtaaacaaaataaaaaacgcacttctatcaaccaacaaagcagtagtatcactatcaaacggagtatccgtcttaacatttaaagttctagacctcaaaaactatatagacaaacaattactgccaatcctcaataaacaatcatgctcaataccaaacatcgaaacagtaatagaatttcaacaaaaaaacaacagactactagaaataacaagagaattttccgtcaacgccggcgtaactactccagtatcaacatatatgctaaccaactcagaactcctatccctcataaacgacatgccaataactaatgatcaaaaaaaactaatgtcaaacaatgtacaaatagttagacaacaatcatactcaatcatgtgcataataaaagaagaagtactagcatacgtcgtccaactacccctatacggagtaatagacacaccttgctggaaactacacacatcacccctatgcacaacaaatacaaaagaaggttccaacatctgcctaacaagaactgatagaggatggtactgcgacaacgccggatcagtatcattcttccctcaagctgaaacctgcaaagtacaatcaaacagagtattttgcgatacaatgaactccctaacacttccctcagaagttaatctttgtaatatagatatattcaacccaaaatacgactgcaaaataatgacaagtaaaacagacgtatcctcatctgtaattacatcactaggagccatagtatcttgctacggcaaaaccaaatgcacagcatcaaacaaaaacagaggtattatcaaaaccttctcaaacggatgtgactacgtttcaaacaaaggagtagacacagtatcagtcggaaacaccctatactgtgttaacaaacaagaaggacaatcactgtacgtaaaaggagaacccataataaatttctacgacccacttgtatttccatcagacgaatttgatgcatcaatctcacaagtaaatgaaaaaataaaccaatcattagcattcataagaaaatctgacgagttactacacaacgtaaatgttggcaaatcaacaaccaatataatgataacaacaataataatagtaataatagtcatattactcctcctcatagccgtcggattattcttatactgcaaagcaagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14357 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut1 (opt11)
  source 1..1813: mol_type = other RNA
gggagactttcccattctgtagcagaatttggtgttgcctgtggtcttggtcccgcggagaagcttaccatggaactccccatactaaaaaccaacgccatcacaacaatcctcgccgccgtcacactctgcttcgccagctcccaaaacatcaccgaagagttctatcaatcaacctgctccgcagtctcaaagggatacctcggagccctccgcaccggatggtacacttccgtcatcacaatagaactctccaacatcaaagaaaacaaatgcaacggcaccgacgcaaaagtcaagctcatcaaacaagaactcgacaaatataaaaacgccgtcaccgaactccaactactcatgcaatccacacccgcggccggctcaggcagcgccatctgctcaggcatcgccgtctgcaaagtcctccacctcgaaggcgaagtcaacaaaatcaaaaacgcccttctttcaaccaacaaggcagtagtatccctctcaaacggcgtcagcgtcctgaccttcaaagtcctagacctcaaaaactacatagataaacaactcctccccatactgaacaaacaatcgtgctccatccccaatatcgaaaccgtcatagagttccagcagaaaaacaacagacttctcgaaataacccgagagttctcagtaaacgccggagtcaccacacccgtaagcacctacatgctcacaaactcagaactcctatccctcatcaacgacatgcccatcaccaacgaccagaaaaagctaatgtccaacaacgtccaaatagtacgccaacaaagctactcgataatgtgcatcatcaaggaagaagtactcgcctacgtcgtccaactccccctctacggcgtaatcgacacaccctgctggaaactccacacgtccccactctgcacaacaaacacaaaagaaggatccaacatatgcctaacccgcaccgacaggggctggtactgcgacaacgcaggctcagtcagcttctttccccaagccgaaacatgcaaagtccaatccaaccgtgtcttctgcgacaccatgaactcgctcaccctaccctcggaagtcaatctctgcaacatcgacatcttcaacccaaaatacgactgtaaaatcatgaccagcaaaacagacgtttcttccagcgtcatcacatcactcggcgcgatcgtatcatgctatggcaaaacaaagtgcaccgctagcaataaaaaccgaggaatcataaaaaccttcagcaacggctgcgactacgtatccaacaaaggcgtcgacaccgtatccgtcggaaacaccctctactgcgtcaacaagcaagaaggacaatcactctacgtcaaaggcgaaccaatcataaacttctacgacccactcgtattcccctcagacgagttcgacgcatccatctcccaagtcaacgaaaagatcaaccaatctctcgcctttatacgcaaaagcgacgaactccttcacaacgtaaacgtcggcaaaagcaccactaacataatgatcaccacaatcataatagtaatcatcgtaatactcctcctactcatcgccgtgggcctattcctctattgcaaagcccgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14358 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut1 (opt1)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14359 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut1 (opt1)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14360 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut1 (opt2)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14361 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut1 (opt3)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14362 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut1 (opt4)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14363 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut1 (opt5)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14364 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut1 (opt6)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaattaccaatactaaaaacaaacgcaataacaacaattctagcagcagtaacattatgctttgcatcatcccaaaacatcacagaagaattttatcaatcaacctgctcagcagtttccaaaggatacttaggagcattaagaactggttggtacacttcagtaatcaccatcgaactctcaaacatcaaggaaaacaaatgcaacggaacagacgcaaaagttaaactcataaaacaagaacttgacaaatacaaaaacgccgtaacagaactacaacttctcatgcaatcaacacccgcagcaggatccggatcagccatatgctcaggcatagcagtatgtaaagtattacatcttgaaggtgaagtaaacaaaataaaaaacgcacttctatcaaccaacaaagcagtagtatcactatcaaacggagtatccgtcttaacatttaaagttctagacctcaaaaactatatagacaaacaattactgccaatcctcaataaacaatcatgctcaataccaaacatcgaaacagtaatagaatttcaacaaaaaaacaacagactactagaaataacaagagaattttccgtcaacgccggcgtaactactccagtatcaacatatatgctaaccaactcagaactcctatccctcataaacgacatgccaataactaatgatcaaaaaaaactaatgtcaaacaatgtacaaatagttagacaacaatcatactcaatcatgtgcataataaaagaagaagtactagcatacgtcgtccaactacccctatacggagtaatagacacaccttgctggaaactacacacatcacccctatgcacaacaaatacaaaagaaggttccaacatctgcctaacaagaactgatagaggatggtactgcgacaacgccggatcagtatcattcttccctcaagctgaaacctgcaaagtacaatcaaacagagtattttgcgatacaatgaactccctaacacttccctcagaagttaatctttgtaatatagatatattcaacccaaaatacgactgcaaaataatgacaagtaaaacagacgtatcctcatctgtaattacatcactaggagccatagtatcttgctacggcaaaaccaaatgcacagcatcaaacaaaaacagaggtattatcaaaaccttctcaaacggatgtgactacgtttcaaacaaaggagtagacacagtatcagtcggaaacaccctatactgtgttaacaaacaagaaggacaatcactgtacgtaaaaggagaacccataataaatttctacgacccacttgtatttccatcagacgaatttgatgcatcaatctcacaagtaaatgaaaaaataaaccaatcattagcattcataagaaaatctgacgagttactacacaacgtaaatgttggcaaatcaacaaccaatataatgataacaacaataataatagtaataatagtcatattactcctcctcatagccgtcggattattcttatactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14365 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut1 (opt11)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactccccatactaaaaaccaacgccatcacaacaatcctcgccgccgtcacactctgcttcgccagctcccaaaacatcaccgaagagttctatcaatcaacctgctccgcagtctcaaagggatacctcggagccctccgcaccggatggtacacttccgtcatcacaatagaactctccaacatcaaagaaaacaaatgcaacggcaccgacgcaaaagtcaagctcatcaaacaagaactcgacaaatataaaaacgccgtcaccgaactccaactactcatgcaatccacacccgcggccggctcaggcagcgccatctgctcaggcatcgccgtctgcaaagtcctccacctcgaaggcgaagtcaacaaaatcaaaaacgcccttctttcaaccaacaaggcagtagtatccctctcaaacggcgtcagcgtcctgaccttcaaagtcctagacctcaaaaactacatagataaacaactcctccccatactgaacaaacaatcgtgctccatccccaatatcgaaaccgtcatagagttccagcagaaaaacaacagacttctcgaaataacccgagagttctcagtaaacgccggagtcaccacacccgtaagcacctacatgctcacaaactcagaactcctatccctcatcaacgacatgcccatcaccaacgaccagaaaaagctaatgtccaacaacgtccaaatagtacgccaacaaagctactcgataatgtgcatcatcaaggaagaagtactcgcctacgtcgtccaactccccctctacggcgtaatcgacacaccctgctggaaactccacacgtccccactctgcacaacaaacacaaaagaaggatccaacatatgcctaacccgcaccgacaggggctggtactgcgacaacgcaggctcagtcagcttctttccccaagccgaaacatgcaaagtccaatccaaccgtgtcttctgcgacaccatgaactcgctcaccctaccctcggaagtcaatctctgcaacatcgacatcttcaacccaaaatacgactgtaaaatcatgaccagcaaaacagacgtttcttccagcgtcatcacatcactcggcgcgatcgtatcatgctatggcaaaacaaagtgcaccgctagcaataaaaaccgaggaatcataaaaaccttcagcaacggctgcgactacgtatccaacaaaggcgtcgacaccgtatccgtcggaaacaccctctactgcgtcaacaagcaagaaggacaatcactctacgtcaaaggcgaaccaatcataaacttctacgacccactcgtattcccctcagacgagttcgacgcatccatctcccaagtcaacgaaaagatcaaccaatctctcgcctttatacgcaaaagcgacgaactccttcacaacgtaaacgtcggcaaaagcaccactaacataatgatcaccacaatcataatagtaatcatcgtaatactcctcctactcatcgccgtgggcctattcctctattgcaaagcccgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14366 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut1 (opt1)
  source 1..1814: mol_type = other RNA
gggagagcctctgctggagtccggggagtggcgttggctgctagagcgaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14367 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut1 (opt1)
  source 1..1814: mol_type = other RNA
gggagagcctctgctggagtccggggagtggcgttggctgctagagcgaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14368 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut1 (opt2)
  source 1..1814: mol_type = other RNA
gggagagcctctgctggagtccggggagtggcgttggctgctagagcgaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14369 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut1 (opt3)
  source 1..1814: mol_type = other RNA
gggagagcctctgctggagtccggggagtggcgttggctgctagagcgaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14370 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut1 (opt4)
  source 1..1814: mol_type = other RNA
gggagagcctctgctggagtccggggagtggcgttggctgctagagcgaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14371 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut1 (opt5)
  source 1..1814: mol_type = other RNA
gggagagcctctgctggagtccggggagtggcgttggctgctagagcgaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14372 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut1 (opt6)
  source 1..1814: mol_type = other RNA
gggagagcctctgctggagtccggggagtggcgttggctgctagagcgaagcttaccatggaattaccaatactaaaaacaaacgcaataacaacaattctagcagcagtaacattatgctttgcatcatcccaaaacatcacagaagaattttatcaatcaacctgctcagcagtttccaaaggatacttaggagcattaagaactggttggtacacttcagtaatcaccatcgaactctcaaacatcaaggaaaacaaatgcaacggaacagacgcaaaagttaaactcataaaacaagaacttgacaaatacaaaaacgccgtaacagaactacaacttctcatgcaatcaacacccgcagcaggatccggatcagccatatgctcaggcatagcagtatgtaaagtattacatcttgaaggtgaagtaaacaaaataaaaaacgcacttctatcaaccaacaaagcagtagtatcactatcaaacggagtatccgtcttaacatttaaagttctagacctcaaaaactatatagacaaacaattactgccaatcctcaataaacaatcatgctcaataccaaacatcgaaacagtaatagaatttcaacaaaaaaacaacagactactagaaataacaagagaattttccgtcaacgccggcgtaactactccagtatcaacatatatgctaaccaactcagaactcctatccctcataaacgacatgccaataactaatgatcaaaaaaaactaatgtcaaacaatgtacaaatagttagacaacaatcatactcaatcatgtgcataataaaagaagaagtactagcatacgtcgtccaactacccctatacggagtaatagacacaccttgctggaaactacacacatcacccctatgcacaacaaatacaaaagaaggttccaacatctgcctaacaagaactgatagaggatggtactgcgacaacgccggatcagtatcattcttccctcaagctgaaacctgcaaagtacaatcaaacagagtattttgcgatacaatgaactccctaacacttccctcagaagttaatctttgtaatatagatatattcaacccaaaatacgactgcaaaataatgacaagtaaaacagacgtatcctcatctgtaattacatcactaggagccatagtatcttgctacggcaaaaccaaatgcacagcatcaaacaaaaacagaggtattatcaaaaccttctcaaacggatgtgactacgtttcaaacaaaggagtagacacagtatcagtcggaaacaccctatactgtgttaacaaacaagaaggacaatcactgtacgtaaaaggagaacccataataaatttctacgacccacttgtatttccatcagacgaatttgatgcatcaatctcacaagtaaatgaaaaaataaaccaatcattagcattcataagaaaatctgacgagttactacacaacgtaaatgttggcaaatcaacaaccaatataatgataacaacaataataatagtaataatagtcatattactcctcctcatagccgtcggattattcttatactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14373 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut1 (opt11)
  source 1..1814: mol_type = other RNA
gggagagcctctgctggagtccggggagtggcgttggctgctagagcgaagcttaccatggaactccccatactaaaaaccaacgccatcacaacaatcctcgccgccgtcacactctgcttcgccagctcccaaaacatcaccgaagagttctatcaatcaacctgctccgcagtctcaaagggatacctcggagccctccgcaccggatggtacacttccgtcatcacaatagaactctccaacatcaaagaaaacaaatgcaacggcaccgacgcaaaagtcaagctcatcaaacaagaactcgacaaatataaaaacgccgtcaccgaactccaactactcatgcaatccacacccgcggccggctcaggcagcgccatctgctcaggcatcgccgtctgcaaagtcctccacctcgaaggcgaagtcaacaaaatcaaaaacgcccttctttcaaccaacaaggcagtagtatccctctcaaacggcgtcagcgtcctgaccttcaaagtcctagacctcaaaaactacatagataaacaactcctccccatactgaacaaacaatcgtgctccatccccaatatcgaaaccgtcatagagttccagcagaaaaacaacagacttctcgaaataacccgagagttctcagtaaacgccggagtcaccacacccgtaagcacctacatgctcacaaactcagaactcctatccctcatcaacgacatgcccatcaccaacgaccagaaaaagctaatgtccaacaacgtccaaatagtacgccaacaaagctactcgataatgtgcatcatcaaggaagaagtactcgcctacgtcgtccaactccccctctacggcgtaatcgacacaccctgctggaaactccacacgtccccactctgcacaacaaacacaaaagaaggatccaacatatgcctaacccgcaccgacaggggctggtactgcgacaacgcaggctcagtcagcttctttccccaagccgaaacatgcaaagtccaatccaaccgtgtcttctgcgacaccatgaactcgctcaccctaccctcggaagtcaatctctgcaacatcgacatcttcaacccaaaatacgactgtaaaatcatgaccagcaaaacagacgtttcttccagcgtcatcacatcactcggcgcgatcgtatcatgctatggcaaaacaaagtgcaccgctagcaataaaaaccgaggaatcataaaaaccttcagcaacggctgcgactacgtatccaacaaaggcgtcgacaccgtatccgtcggaaacaccctctactgcgtcaacaagcaagaaggacaatcactctacgtcaaaggcgaaccaatcataaacttctacgacccactcgtattcccctcagacgagttcgacgcatccatctcccaagtcaacgaaaagatcaaccaatctctcgcctttatacgcaaaagcgacgaactccttcacaacgtaaacgtcggcaaaagcaccactaacataatgatcaccacaatcataatagtaatcatcgtaatactcctcctactcatcgccgtgggcctattcctctattgcaaagcccgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14374 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut1 (opt1)
  source 1..1834: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14375 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut1 (opt1)
  source 1..1834: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14376 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut1 (opt2)
  source 1..1834: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14377 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut1 (opt3)
  source 1..1834: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14378 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut1 (opt4)
  source 1..1834: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14379 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut1 (opt5)
  source 1..1834: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14380 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut1 (opt6)
  source 1..1834: mol_type = other RNA
gggagagtcccgcagtcggcgtccagcggctctgcttgttcgtgtgtgtgtcgttgcaggccttattcaagcttaccatggaattaccaatactaaaaacaaacgcaataacaacaattctagcagcagtaacattatgctttgcatcatcccaaaacatcacagaagaattttatcaatcaacctgctcagcagtttccaaaggatacttaggagcattaagaactggttggtacacttcagtaatcaccatcgaactctcaaacatcaaggaaaacaaatgcaacggaacagacgcaaaagttaaactcataaaacaagaacttgacaaatacaaaaacgccgtaacagaactacaacttctcatgcaatcaacacccgcagcaggatccggatcagccatatgctcaggcatagcagtatgtaaagtattacatcttgaaggtgaagtaaacaaaataaaaaacgcacttctatcaaccaacaaagcagtagtatcactatcaaacggagtatccgtcttaacatttaaagttctagacctcaaaaactatatagacaaacaattactgccaatcctcaataaacaatcatgctcaataccaaacatcgaaacagtaatagaatttcaacaaaaaaacaacagactactagaaataacaagagaattttccgtcaacgccggcgtaactactccagtatcaacatatatgctaaccaactcagaactcctatccctcataaacgacatgccaataactaatgatcaaaaaaaactaatgtcaaacaatgtacaaatagttagacaacaatcatactcaatcatgtgcataataaaagaagaagtactagcatacgtcgtccaactacccctatacggagtaatagacacaccttgctggaaactacacacatcacccctatgcacaacaaatacaaaagaaggttccaacatctgcctaacaagaactgatagaggatggtactgcgacaacgccggatcagtatcattcttccctcaagctgaaacctgcaaagtacaatcaaacagagtattttgcgatacaatgaactccctaacacttccctcagaagttaatctttgtaatatagatatattcaacccaaaatacgactgcaaaataatgacaagtaaaacagacgtatcctcatctgtaattacatcactaggagccatagtatcttgctacggcaaaaccaaatgcacagcatcaaacaaaaacagaggtattatcaaaaccttctcaaacggatgtgactacgtttcaaacaaaggagtagacacagtatcagtcggaaacaccctatactgtgttaacaaacaagaaggacaatcactgtacgtaaaaggagaacccataataaatttctacgacccacttgtatttccatcagacgaatttgatgcatcaatctcacaagtaaatgaaaaaataaaccaatcattagcattcataagaaaatctgacgagttactacacaacgtaaatgttggcaaatcaacaaccaatataatgataacaacaataataatagtaataatagtcatattactcctcctcatagccgtcggattattcttatactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14381 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut1 (opt11)
  source 1..1834: mol_type = other RNA
gggagagtcccgcagtcggcgtccagcggctctgcttgttcgtgtgtgtgtcgttgcaggccttattcaagcttaccatggaactccccatactaaaaaccaacgccatcacaacaatcctcgccgccgtcacactctgcttcgccagctcccaaaacatcaccgaagagttctatcaatcaacctgctccgcagtctcaaagggatacctcggagccctccgcaccggatggtacacttccgtcatcacaatagaactctccaacatcaaagaaaacaaatgcaacggcaccgacgcaaaagtcaagctcatcaaacaagaactcgacaaatataaaaacgccgtcaccgaactccaactactcatgcaatccacacccgcggccggctcaggcagcgccatctgctcaggcatcgccgtctgcaaagtcctccacctcgaaggcgaagtcaacaaaatcaaaaacgcccttctttcaaccaacaaggcagtagtatccctctcaaacggcgtcagcgtcctgaccttcaaagtcctagacctcaaaaactacatagataaacaactcctccccatactgaacaaacaatcgtgctccatccccaatatcgaaaccgtcatagagttccagcagaaaaacaacagacttctcgaaataacccgagagttctcagtaaacgccggagtcaccacacccgtaagcacctacatgctcacaaactcagaactcctatccctcatcaacgacatgcccatcaccaacgaccagaaaaagctaatgtccaacaacgtccaaatagtacgccaacaaagctactcgataatgtgcatcatcaaggaagaagtactcgcctacgtcgtccaactccccctctacggcgtaatcgacacaccctgctggaaactccacacgtccccactctgcacaacaaacacaaaagaaggatccaacatatgcctaacccgcaccgacaggggctggtactgcgacaacgcaggctcagtcagcttctttccccaagccgaaacatgcaaagtccaatccaaccgtgtcttctgcgacaccatgaactcgctcaccctaccctcggaagtcaatctctgcaacatcgacatcttcaacccaaaatacgactgtaaaatcatgaccagcaaaacagacgtttcttccagcgtcatcacatcactcggcgcgatcgtatcatgctatggcaaaacaaagtgcaccgctagcaataaaaaccgaggaatcataaaaaccttcagcaacggctgcgactacgtatccaacaaaggcgtcgacaccgtatccgtcggaaacaccctctactgcgtcaacaagcaagaaggacaatcactctacgtcaaaggcgaaccaatcataaacttctacgacccactcgtattcccctcagacgagttcgacgcatccatctcccaagtcaacgaaaagatcaaccaatctctcgcctttatacgcaaaagcgacgaactccttcacaacgtaaacgtcggcaaaagcaccactaacataatgatcaccacaatcataatagtaatcatcgtaatactcctcctactcatcgccgtgggcctattcctctattgcaaagcccgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14382 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut1 (opt1)
  source 1..1885: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14383 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut1 (opt1)
  source 1..1885: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14384 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut1 (opt2)
  source 1..1885: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14385 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut1 (opt3)
  source 1..1885: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14386 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut1 (opt4)
  source 1..1885: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14387 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut1 (opt5)
  source 1..1885: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14388 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut1 (opt6)
  source 1..1885: mol_type = other RNA
gggagagtcccgcagtcggcgtccagcggctctgcttgttcgtgtgtgtgtcgttgcaggccttattcaagcttaccatggaattaccaatactaaaaacaaacgcaataacaacaattctagcagcagtaacattatgctttgcatcatcccaaaacatcacagaagaattttatcaatcaacctgctcagcagtttccaaaggatacttaggagcattaagaactggttggtacacttcagtaatcaccatcgaactctcaaacatcaaggaaaacaaatgcaacggaacagacgcaaaagttaaactcataaaacaagaacttgacaaatacaaaaacgccgtaacagaactacaacttctcatgcaatcaacacccgcagcaggatccggatcagccatatgctcaggcatagcagtatgtaaagtattacatcttgaaggtgaagtaaacaaaataaaaaacgcacttctatcaaccaacaaagcagtagtatcactatcaaacggagtatccgtcttaacatttaaagttctagacctcaaaaactatatagacaaacaattactgccaatcctcaataaacaatcatgctcaataccaaacatcgaaacagtaatagaatttcaacaaaaaaacaacagactactagaaataacaagagaattttccgtcaacgccggcgtaactactccagtatcaacatatatgctaaccaactcagaactcctatccctcataaacgacatgccaataactaatgatcaaaaaaaactaatgtcaaacaatgtacaaatagttagacaacaatcatactcaatcatgtgcataataaaagaagaagtactagcatacgtcgtccaactacccctatacggagtaatagacacaccttgctggaaactacacacatcacccctatgcacaacaaatacaaaagaaggttccaacatctgcctaacaagaactgatagaggatggtactgcgacaacgccggatcagtatcattcttccctcaagctgaaacctgcaaagtacaatcaaacagagtattttgcgatacaatgaactccctaacacttccctcagaagttaatctttgtaatatagatatattcaacccaaaatacgactgcaaaataatgacaagtaaaacagacgtatcctcatctgtaattacatcactaggagccatagtatcttgctacggcaaaaccaaatgcacagcatcaaacaaaaacagaggtattatcaaaaccttctcaaacggatgtgactacgtttcaaacaaaggagtagacacagtatcagtcggaaacaccctatactgtgttaacaaacaagaaggacaatcactgtacgtaaaaggagaacccataataaatttctacgacccacttgtatttccatcagacgaatttgatgcatcaatctcacaagtaaatgaaaaaataaaccaatcattagcattcataagaaaatctgacgagttactacacaacgtaaatgttggcaaatcaacaaccaatataatgataacaacaataataatagtaataatagtcatattactcctcctcatagccgtcggattattcttatactgcaaagcaagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14389 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut1 (opt11)
  source 1..1885: mol_type = other RNA
gggagagtcccgcagtcggcgtccagcggctctgcttgttcgtgtgtgtgtcgttgcaggccttattcaagcttaccatggaactccccatactaaaaaccaacgccatcacaacaatcctcgccgccgtcacactctgcttcgccagctcccaaaacatcaccgaagagttctatcaatcaacctgctccgcagtctcaaagggatacctcggagccctccgcaccggatggtacacttccgtcatcacaatagaactctccaacatcaaagaaaacaaatgcaacggcaccgacgcaaaagtcaagctcatcaaacaagaactcgacaaatataaaaacgccgtcaccgaactccaactactcatgcaatccacacccgcggccggctcaggcagcgccatctgctcaggcatcgccgtctgcaaagtcctccacctcgaaggcgaagtcaacaaaatcaaaaacgcccttctttcaaccaacaaggcagtagtatccctctcaaacggcgtcagcgtcctgaccttcaaagtcctagacctcaaaaactacatagataaacaactcctccccatactgaacaaacaatcgtgctccatccccaatatcgaaaccgtcatagagttccagcagaaaaacaacagacttctcgaaataacccgagagttctcagtaaacgccggagtcaccacacccgtaagcacctacatgctcacaaactcagaactcctatccctcatcaacgacatgcccatcaccaacgaccagaaaaagctaatgtccaacaacgtccaaatagtacgccaacaaagctactcgataatgtgcatcatcaaggaagaagtactcgcctacgtcgtccaactccccctctacggcgtaatcgacacaccctgctggaaactccacacgtccccactctgcacaacaaacacaaaagaaggatccaacatatgcctaacccgcaccgacaggggctggtactgcgacaacgcaggctcagtcagcttctttccccaagccgaaacatgcaaagtccaatccaaccgtgtcttctgcgacaccatgaactcgctcaccctaccctcggaagtcaatctctgcaacatcgacatcttcaacccaaaatacgactgtaaaatcatgaccagcaaaacagacgtttcttccagcgtcatcacatcactcggcgcgatcgtatcatgctatggcaaaacaaagtgcaccgctagcaataaaaaccgaggaatcataaaaaccttcagcaacggctgcgactacgtatccaacaaaggcgtcgacaccgtatccgtcggaaacaccctctactgcgtcaacaagcaagaaggacaatcactctacgtcaaaggcgaaccaatcataaacttctacgacccactcgtattcccctcagacgagttcgacgcatccatctcccaagtcaacgaaaagatcaaccaatctctcgcctttatacgcaaaagcgacgaactccttcacaacgtaaacgtcggcaaaagcaccactaacataatgatcaccacaatcataatagtaatcatcgtaatactcctcctactcatcgccgtgggcctattcctctattgcaaagcccgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14390 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut1 (opt1)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14391 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut1 (opt1)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14392 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut1 (opt2)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14393 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut1 (opt3)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14394 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut1 (opt4)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14395 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut1 (opt5)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14396 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut1 (opt6)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattaccaatactaaaaacaaacgcaataacaacaattctagcagcagtaacattatgctttgcatcatcccaaaacatcacagaagaattttatcaatcaacctgctcagcagtttccaaaggatacttaggagcattaagaactggttggtacacttcagtaatcaccatcgaactctcaaacatcaaggaaaacaaatgcaacggaacagacgcaaaagttaaactcataaaacaagaacttgacaaatacaaaaacgccgtaacagaactacaacttctcatgcaatcaacacccgcagcaggatccggatcagccatatgctcaggcatagcagtatgtaaagtattacatcttgaaggtgaagtaaacaaaataaaaaacgcacttctatcaaccaacaaagcagtagtatcactatcaaacggagtatccgtcttaacatttaaagttctagacctcaaaaactatatagacaaacaattactgccaatcctcaataaacaatcatgctcaataccaaacatcgaaacagtaatagaatttcaacaaaaaaacaacagactactagaaataacaagagaattttccgtcaacgccggcgtaactactccagtatcaacatatatgctaaccaactcagaactcctatccctcataaacgacatgccaataactaatgatcaaaaaaaactaatgtcaaacaatgtacaaatagttagacaacaatcatactcaatcatgtgcataataaaagaagaagtactagcatacgtcgtccaactacccctatacggagtaatagacacaccttgctggaaactacacacatcacccctatgcacaacaaatacaaaagaaggttccaacatctgcctaacaagaactgatagaggatggtactgcgacaacgccggatcagtatcattcttccctcaagctgaaacctgcaaagtacaatcaaacagagtattttgcgatacaatgaactccctaacacttccctcagaagttaatctttgtaatatagatatattcaacccaaaatacgactgcaaaataatgacaagtaaaacagacgtatcctcatctgtaattacatcactaggagccatagtatcttgctacggcaaaaccaaatgcacagcatcaaacaaaaacagaggtattatcaaaaccttctcaaacggatgtgactacgtttcaaacaaaggagtagacacagtatcagtcggaaacaccctatactgtgttaacaaacaagaaggacaatcactgtacgtaaaaggagaacccataataaatttctacgacccacttgtatttccatcagacgaatttgatgcatcaatctcacaagtaaatgaaaaaataaaccaatcattagcattcataagaaaatctgacgagttactacacaacgtaaatgttggcaaatcaacaaccaatataatgataacaacaataataatagtaataatagtcatattactcctcctcatagccgtcggattattcttatactgcaaagcaagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14397 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut1 (opt11)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactccccatactaaaaaccaacgccatcacaacaatcctcgccgccgtcacactctgcttcgccagctcccaaaacatcaccgaagagttctatcaatcaacctgctccgcagtctcaaagggatacctcggagccctccgcaccggatggtacacttccgtcatcacaatagaactctccaacatcaaagaaaacaaatgcaacggcaccgacgcaaaagtcaagctcatcaaacaagaactcgacaaatataaaaacgccgtcaccgaactccaactactcatgcaatccacacccgcggccggctcaggcagcgccatctgctcaggcatcgccgtctgcaaagtcctccacctcgaaggcgaagtcaacaaaatcaaaaacgcccttctttcaaccaacaaggcagtagtatccctctcaaacggcgtcagcgtcctgaccttcaaagtcctagacctcaaaaactacatagataaacaactcctccccatactgaacaaacaatcgtgctccatccccaatatcgaaaccgtcatagagttccagcagaaaaacaacagacttctcgaaataacccgagagttctcagtaaacgccggagtcaccacacccgtaagcacctacatgctcacaaactcagaactcctatccctcatcaacgacatgcccatcaccaacgaccagaaaaagctaatgtccaacaacgtccaaatagtacgccaacaaagctactcgataatgtgcatcatcaaggaagaagtactcgcctacgtcgtccaactccccctctacggcgtaatcgacacaccctgctggaaactccacacgtccccactctgcacaacaaacacaaaagaaggatccaacatatgcctaacccgcaccgacaggggctggtactgcgacaacgcaggctcagtcagcttctttccccaagccgaaacatgcaaagtccaatccaaccgtgtcttctgcgacaccatgaactcgctcaccctaccctcggaagtcaatctctgcaacatcgacatcttcaacccaaaatacgactgtaaaatcatgaccagcaaaacagacgtttcttccagcgtcatcacatcactcggcgcgatcgtatcatgctatggcaaaacaaagtgcaccgctagcaataaaaaccgaggaatcataaaaaccttcagcaacggctgcgactacgtatccaacaaaggcgtcgacaccgtatccgtcggaaacaccctctactgcgtcaacaagcaagaaggacaatcactctacgtcaaaggcgaaccaatcataaacttctacgacccactcgtattcccctcagacgagttcgacgcatccatctcccaagtcaacgaaaagatcaaccaatctctcgcctttatacgcaaaagcgacgaactccttcacaacgtaaacgtcggcaaaagcaccactaacataatgatcaccacaatcataatagtaatcatcgtaatactcctcctactcatcgccgtgggcctattcctctattgcaaagcccgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14398 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut1 (opt1)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14399 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut1 (opt1)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14400 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut1 (opt2)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14401 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut1 (opt3)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14402 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut1 (opt4)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14403 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut1 (opt5)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14404 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut1 (opt6)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggaattaccaatactaaaaacaaacgcaataacaacaattctagcagcagtaacattatgctttgcatcatcccaaaacatcacagaagaattttatcaatcaacctgctcagcagtttccaaaggatacttaggagcattaagaactggttggtacacttcagtaatcaccatcgaactctcaaacatcaaggaaaacaaatgcaacggaacagacgcaaaagttaaactcataaaacaagaacttgacaaatacaaaaacgccgtaacagaactacaacttctcatgcaatcaacacccgcagcaggatccggatcagccatatgctcaggcatagcagtatgtaaagtattacatcttgaaggtgaagtaaacaaaataaaaaacgcacttctatcaaccaacaaagcagtagtatcactatcaaacggagtatccgtcttaacatttaaagttctagacctcaaaaactatatagacaaacaattactgccaatcctcaataaacaatcatgctcaataccaaacatcgaaacagtaatagaatttcaacaaaaaaacaacagactactagaaataacaagagaattttccgtcaacgccggcgtaactactccagtatcaacatatatgctaaccaactcagaactcctatccctcataaacgacatgccaataactaatgatcaaaaaaaactaatgtcaaacaatgtacaaatagttagacaacaatcatactcaatcatgtgcataataaaagaagaagtactagcatacgtcgtccaactacccctatacggagtaatagacacaccttgctggaaactacacacatcacccctatgcacaacaaatacaaaagaaggttccaacatctgcctaacaagaactgatagaggatggtactgcgacaacgccggatcagtatcattcttccctcaagctgaaacctgcaaagtacaatcaaacagagtattttgcgatacaatgaactccctaacacttccctcagaagttaatctttgtaatatagatatattcaacccaaaatacgactgcaaaataatgacaagtaaaacagacgtatcctcatctgtaattacatcactaggagccatagtatcttgctacggcaaaaccaaatgcacagcatcaaacaaaaacagaggtattatcaaaaccttctcaaacggatgtgactacgtttcaaacaaaggagtagacacagtatcagtcggaaacaccctatactgtgttaacaaacaagaaggacaatcactgtacgtaaaaggagaacccataataaatttctacgacccacttgtatttccatcagacgaatttgatgcatcaatctcacaagtaaatgaaaaaataaaccaatcattagcattcataagaaaatctgacgagttactacacaacgtaaatgttggcaaatcaacaaccaatataatgataacaacaataataatagtaataatagtcatattactcctcctcatagccgtcggattattcttatactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14405 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut1 (opt11)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggaactccccatactaaaaaccaacgccatcacaacaatcctcgccgccgtcacactctgcttcgccagctcccaaaacatcaccgaagagttctatcaatcaacctgctccgcagtctcaaagggatacctcggagccctccgcaccggatggtacacttccgtcatcacaatagaactctccaacatcaaagaaaacaaatgcaacggcaccgacgcaaaagtcaagctcatcaaacaagaactcgacaaatataaaaacgccgtcaccgaactccaactactcatgcaatccacacccgcggccggctcaggcagcgccatctgctcaggcatcgccgtctgcaaagtcctccacctcgaaggcgaagtcaacaaaatcaaaaacgcccttctttcaaccaacaaggcagtagtatccctctcaaacggcgtcagcgtcctgaccttcaaagtcctagacctcaaaaactacatagataaacaactcctccccatactgaacaaacaatcgtgctccatccccaatatcgaaaccgtcatagagttccagcagaaaaacaacagacttctcgaaataacccgagagttctcagtaaacgccggagtcaccacacccgtaagcacctacatgctcacaaactcagaactcctatccctcatcaacgacatgcccatcaccaacgaccagaaaaagctaatgtccaacaacgtccaaatagtacgccaacaaagctactcgataatgtgcatcatcaaggaagaagtactcgcctacgtcgtccaactccccctctacggcgtaatcgacacaccctgctggaaactccacacgtccccactctgcacaacaaacacaaaagaaggatccaacatatgcctaacccgcaccgacaggggctggtactgcgacaacgcaggctcagtcagcttctttccccaagccgaaacatgcaaagtccaatccaaccgtgtcttctgcgacaccatgaactcgctcaccctaccctcggaagtcaatctctgcaacatcgacatcttcaacccaaaatacgactgtaaaatcatgaccagcaaaacagacgtttcttccagcgtcatcacatcactcggcgcgatcgtatcatgctatggcaaaacaaagtgcaccgctagcaataaaaaccgaggaatcataaaaaccttcagcaacggctgcgactacgtatccaacaaaggcgtcgacaccgtatccgtcggaaacaccctctactgcgtcaacaagcaagaaggacaatcactctacgtcaaaggcgaaccaatcataaacttctacgacccactcgtattcccctcagacgagttcgacgcatccatctcccaagtcaacgaaaagatcaaccaatctctcgcctttatacgcaaaagcgacgaactccttcacaacgtaaacgtcggcaaaagcaccactaacataatgatcaccacaatcataatagtaatcatcgtaatactcctcctactcatcgccgtgggcctattcctctattgcaaagcccgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14406 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut1 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14407 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut1 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14408 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut1 (opt2)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14409 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut1 (opt3)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14410 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut1 (opt4)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14411 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut1 (opt5)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14412 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut1 (opt6)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattaccaatactaaaaacaaacgcaataacaacaattctagcagcagtaacattatgctttgcatcatcccaaaacatcacagaagaattttatcaatcaacctgctcagcagtttccaaaggatacttaggagcattaagaactggttggtacacttcagtaatcaccatcgaactctcaaacatcaaggaaaacaaatgcaacggaacagacgcaaaagttaaactcataaaacaagaacttgacaaatacaaaaacgccgtaacagaactacaacttctcatgcaatcaacacccgcagcaggatccggatcagccatatgctcaggcatagcagtatgtaaagtattacatcttgaaggtgaagtaaacaaaataaaaaacgcacttctatcaaccaacaaagcagtagtatcactatcaaacggagtatccgtcttaacatttaaagttctagacctcaaaaactatatagacaaacaattactgccaatcctcaataaacaatcatgctcaataccaaacatcgaaacagtaatagaatttcaacaaaaaaacaacagactactagaaataacaagagaattttccgtcaacgccggcgtaactactccagtatcaacatatatgctaaccaactcagaactcctatccctcataaacgacatgccaataactaatgatcaaaaaaaactaatgtcaaacaatgtacaaatagttagacaacaatcatactcaatcatgtgcataataaaagaagaagtactagcatacgtcgtccaactacccctatacggagtaatagacacaccttgctggaaactacacacatcacccctatgcacaacaaatacaaaagaaggttccaacatctgcctaacaagaactgatagaggatggtactgcgacaacgccggatcagtatcattcttccctcaagctgaaacctgcaaagtacaatcaaacagagtattttgcgatacaatgaactccctaacacttccctcagaagttaatctttgtaatatagatatattcaacccaaaatacgactgcaaaataatgacaagtaaaacagacgtatcctcatctgtaattacatcactaggagccatagtatcttgctacggcaaaaccaaatgcacagcatcaaacaaaaacagaggtattatcaaaaccttctcaaacggatgtgactacgtttcaaacaaaggagtagacacagtatcagtcggaaacaccctatactgtgttaacaaacaagaaggacaatcactgtacgtaaaaggagaacccataataaatttctacgacccacttgtatttccatcagacgaatttgatgcatcaatctcacaagtaaatgaaaaaataaaccaatcattagcattcataagaaaatctgacgagttactacacaacgtaaatgttggcaaatcaacaaccaatataatgataacaacaataataatagtaataatagtcatattactcctcctcatagccgtcggattattcttatactgcaaagcaagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14413 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut1 (opt11)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactccccatactaaaaaccaacgccatcacaacaatcctcgccgccgtcacactctgcttcgccagctcccaaaacatcaccgaagagttctatcaatcaacctgctccgcagtctcaaagggatacctcggagccctccgcaccggatggtacacttccgtcatcacaatagaactctccaacatcaaagaaaacaaatgcaacggcaccgacgcaaaagtcaagctcatcaaacaagaactcgacaaatataaaaacgccgtcaccgaactccaactactcatgcaatccacacccgcggccggctcaggcagcgccatctgctcaggcatcgccgtctgcaaagtcctccacctcgaaggcgaagtcaacaaaatcaaaaacgcccttctttcaaccaacaaggcagtagtatccctctcaaacggcgtcagcgtcctgaccttcaaagtcctagacctcaaaaactacatagataaacaactcctccccatactgaacaaacaatcgtgctccatccccaatatcgaaaccgtcatagagttccagcagaaaaacaacagacttctcgaaataacccgagagttctcagtaaacgccggagtcaccacacccgtaagcacctacatgctcacaaactcagaactcctatccctcatcaacgacatgcccatcaccaacgaccagaaaaagctaatgtccaacaacgtccaaatagtacgccaacaaagctactcgataatgtgcatcatcaaggaagaagtactcgcctacgtcgtccaactccccctctacggcgtaatcgacacaccctgctggaaactccacacgtccccactctgcacaacaaacacaaaagaaggatccaacatatgcctaacccgcaccgacaggggctggtactgcgacaacgcaggctcagtcagcttctttccccaagccgaaacatgcaaagtccaatccaaccgtgtcttctgcgacaccatgaactcgctcaccctaccctcggaagtcaatctctgcaacatcgacatcttcaacccaaaatacgactgtaaaatcatgaccagcaaaacagacgtttcttccagcgtcatcacatcactcggcgcgatcgtatcatgctatggcaaaacaaagtgcaccgctagcaataaaaaccgaggaatcataaaaaccttcagcaacggctgcgactacgtatccaacaaaggcgtcgacaccgtatccgtcggaaacaccctctactgcgtcaacaagcaagaaggacaatcactctacgtcaaaggcgaaccaatcataaacttctacgacccactcgtattcccctcagacgagttcgacgcatccatctcccaagtcaacgaaaagatcaaccaatctctcgcctttatacgcaaaagcgacgaactccttcacaacgtaaacgtcggcaaaagcaccactaacataatgatcaccacaatcataatagtaatcatcgtaatactcctcctactcatcgccgtgggcctattcctctattgcaaagcccgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14414 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut1 (opt1)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14415 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut1 (opt1)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14416 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut1 (opt2)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14417 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut1 (opt3)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14418 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut1 (opt4)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14419 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut1 (opt5)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14420 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut1 (opt6)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggaattaccaatactaaaaacaaacgcaataacaacaattctagcagcagtaacattatgctttgcatcatcccaaaacatcacagaagaattttatcaatcaacctgctcagcagtttccaaaggatacttaggagcattaagaactggttggtacacttcagtaatcaccatcgaactctcaaacatcaaggaaaacaaatgcaacggaacagacgcaaaagttaaactcataaaacaagaacttgacaaatacaaaaacgccgtaacagaactacaacttctcatgcaatcaacacccgcagcaggatccggatcagccatatgctcaggcatagcagtatgtaaagtattacatcttgaaggtgaagtaaacaaaataaaaaacgcacttctatcaaccaacaaagcagtagtatcactatcaaacggagtatccgtcttaacatttaaagttctagacctcaaaaactatatagacaaacaattactgccaatcctcaataaacaatcatgctcaataccaaacatcgaaacagtaatagaatttcaacaaaaaaacaacagactactagaaataacaagagaattttccgtcaacgccggcgtaactactccagtatcaacatatatgctaaccaactcagaactcctatccctcataaacgacatgccaataactaatgatcaaaaaaaactaatgtcaaacaatgtacaaatagttagacaacaatcatactcaatcatgtgcataataaaagaagaagtactagcatacgtcgtccaactacccctatacggagtaatagacacaccttgctggaaactacacacatcacccctatgcacaacaaatacaaaagaaggttccaacatctgcctaacaagaactgatagaggatggtactgcgacaacgccggatcagtatcattcttccctcaagctgaaacctgcaaagtacaatcaaacagagtattttgcgatacaatgaactccctaacacttccctcagaagttaatctttgtaatatagatatattcaacccaaaatacgactgcaaaataatgacaagtaaaacagacgtatcctcatctgtaattacatcactaggagccatagtatcttgctacggcaaaaccaaatgcacagcatcaaacaaaaacagaggtattatcaaaaccttctcaaacggatgtgactacgtttcaaacaaaggagtagacacagtatcagtcggaaacaccctatactgtgttaacaaacaagaaggacaatcactgtacgtaaaaggagaacccataataaatttctacgacccacttgtatttccatcagacgaatttgatgcatcaatctcacaagtaaatgaaaaaataaaccaatcattagcattcataagaaaatctgacgagttactacacaacgtaaatgttggcaaatcaacaaccaatataatgataacaacaataataatagtaataatagtcatattactcctcctcatagccgtcggattattcttatactgcaaagcaagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14421 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut1 (opt11)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggaactccccatactaaaaaccaacgccatcacaacaatcctcgccgccgtcacactctgcttcgccagctcccaaaacatcaccgaagagttctatcaatcaacctgctccgcagtctcaaagggatacctcggagccctccgcaccggatggtacacttccgtcatcacaatagaactctccaacatcaaagaaaacaaatgcaacggcaccgacgcaaaagtcaagctcatcaaacaagaactcgacaaatataaaaacgccgtcaccgaactccaactactcatgcaatccacacccgcggccggctcaggcagcgccatctgctcaggcatcgccgtctgcaaagtcctccacctcgaaggcgaagtcaacaaaatcaaaaacgcccttctttcaaccaacaaggcagtagtatccctctcaaacggcgtcagcgtcctgaccttcaaagtcctagacctcaaaaactacatagataaacaactcctccccatactgaacaaacaatcgtgctccatccccaatatcgaaaccgtcatagagttccagcagaaaaacaacagacttctcgaaataacccgagagttctcagtaaacgccggagtcaccacacccgtaagcacctacatgctcacaaactcagaactcctatccctcatcaacgacatgcccatcaccaacgaccagaaaaagctaatgtccaacaacgtccaaatagtacgccaacaaagctactcgataatgtgcatcatcaaggaagaagtactcgcctacgtcgtccaactccccctctacggcgtaatcgacacaccctgctggaaactccacacgtccccactctgcacaacaaacacaaaagaaggatccaacatatgcctaacccgcaccgacaggggctggtactgcgacaacgcaggctcagtcagcttctttccccaagccgaaacatgcaaagtccaatccaaccgtgtcttctgcgacaccatgaactcgctcaccctaccctcggaagtcaatctctgcaacatcgacatcttcaacccaaaatacgactgtaaaatcatgaccagcaaaacagacgtttcttccagcgtcatcacatcactcggcgcgatcgtatcatgctatggcaaaacaaagtgcaccgctagcaataaaaaccgaggaatcataaaaaccttcagcaacggctgcgactacgtatccaacaaaggcgtcgacaccgtatccgtcggaaacaccctctactgcgtcaacaagcaagaaggacaatcactctacgtcaaaggcgaaccaatcataaacttctacgacccactcgtattcccctcagacgagttcgacgcatccatctcccaagtcaacgaaaagatcaaccaatctctcgcctttatacgcaaaagcgacgaactccttcacaacgtaaacgtcggcaaaagcaccactaacataatgatcaccacaatcataatagtaatcatcgtaatactcctcctactcatcgccgtgggcctattcctctattgcaaagcccgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14422 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut1 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14423 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut1 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14424 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut1 (opt2)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14425 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut1 (opt3)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14426 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut1 (opt4)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14427 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut1 (opt5)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14428 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut1 (opt6)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaattaccaatactaaaaacaaacgcaataacaacaattctagcagcagtaacattatgctttgcatcatcccaaaacatcacagaagaattttatcaatcaacctgctcagcagtttccaaaggatacttaggagcattaagaactggttggtacacttcagtaatcaccatcgaactctcaaacatcaaggaaaacaaatgcaacggaacagacgcaaaagttaaactcataaaacaagaacttgacaaatacaaaaacgccgtaacagaactacaacttctcatgcaatcaacacccgcagcaggatccggatcagccatatgctcaggcatagcagtatgtaaagtattacatcttgaaggtgaagtaaacaaaataaaaaacgcacttctatcaaccaacaaagcagtagtatcactatcaaacggagtatccgtcttaacatttaaagttctagacctcaaaaactatatagacaaacaattactgccaatcctcaataaacaatcatgctcaataccaaacatcgaaacagtaatagaatttcaacaaaaaaacaacagactactagaaataacaagagaattttccgtcaacgccggcgtaactactccagtatcaacatatatgctaaccaactcagaactcctatccctcataaacgacatgccaataactaatgatcaaaaaaaactaatgtcaaacaatgtacaaatagttagacaacaatcatactcaatcatgtgcataataaaagaagaagtactagcatacgtcgtccaactacccctatacggagtaatagacacaccttgctggaaactacacacatcacccctatgcacaacaaatacaaaagaaggttccaacatctgcctaacaagaactgatagaggatggtactgcgacaacgccggatcagtatcattcttccctcaagctgaaacctgcaaagtacaatcaaacagagtattttgcgatacaatgaactccctaacacttccctcagaagttaatctttgtaatatagatatattcaacccaaaatacgactgcaaaataatgacaagtaaaacagacgtatcctcatctgtaattacatcactaggagccatagtatcttgctacggcaaaaccaaatgcacagcatcaaacaaaaacagaggtattatcaaaaccttctcaaacggatgtgactacgtttcaaacaaaggagtagacacagtatcagtcggaaacaccctatactgtgttaacaaacaagaaggacaatcactgtacgtaaaaggagaacccataataaatttctacgacccacttgtatttccatcagacgaatttgatgcatcaatctcacaagtaaatgaaaaaataaaccaatcattagcattcataagaaaatctgacgagttactacacaacgtaaatgttggcaaatcaacaaccaatataatgataacaacaataataatagtaataatagtcatattactcctcctcatagccgtcggattattcttatactgcaaagcaagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14429 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut1 (opt11)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaactccccatactaaaaaccaacgccatcacaacaatcctcgccgccgtcacactctgcttcgccagctcccaaaacatcaccgaagagttctatcaatcaacctgctccgcagtctcaaagggatacctcggagccctccgcaccggatggtacacttccgtcatcacaatagaactctccaacatcaaagaaaacaaatgcaacggcaccgacgcaaaagtcaagctcatcaaacaagaactcgacaaatataaaaacgccgtcaccgaactccaactactcatgcaatccacacccgcggccggctcaggcagcgccatctgctcaggcatcgccgtctgcaaagtcctccacctcgaaggcgaagtcaacaaaatcaaaaacgcccttctttcaaccaacaaggcagtagtatccctctcaaacggcgtcagcgtcctgaccttcaaagtcctagacctcaaaaactacatagataaacaactcctccccatactgaacaaacaatcgtgctccatccccaatatcgaaaccgtcatagagttccagcagaaaaacaacagacttctcgaaataacccgagagttctcagtaaacgccggagtcaccacacccgtaagcacctacatgctcacaaactcagaactcctatccctcatcaacgacatgcccatcaccaacgaccagaaaaagctaatgtccaacaacgtccaaatagtacgccaacaaagctactcgataatgtgcatcatcaaggaagaagtactcgcctacgtcgtccaactccccctctacggcgtaatcgacacaccctgctggaaactccacacgtccccactctgcacaacaaacacaaaagaaggatccaacatatgcctaacccgcaccgacaggggctggtactgcgacaacgcaggctcagtcagcttctttccccaagccgaaacatgcaaagtccaatccaaccgtgtcttctgcgacaccatgaactcgctcaccctaccctcggaagtcaatctctgcaacatcgacatcttcaacccaaaatacgactgtaaaatcatgaccagcaaaacagacgtttcttccagcgtcatcacatcactcggcgcgatcgtatcatgctatggcaaaacaaagtgcaccgctagcaataaaaaccgaggaatcataaaaaccttcagcaacggctgcgactacgtatccaacaaaggcgtcgacaccgtatccgtcggaaacaccctctactgcgtcaacaagcaagaaggacaatcactctacgtcaaaggcgaaccaatcataaacttctacgacccactcgtattcccctcagacgagttcgacgcatccatctcccaagtcaacgaaaagatcaaccaatctctcgcctttatacgcaaaagcgacgaactccttcacaacgtaaacgtcggcaaaagcaccactaacataatgatcaccacaatcataatagtaatcatcgtaatactcctcctactcatcgccgtgggcctattcctctattgcaaagcccgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14430 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut1 (opt1)
  source 1..1834: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14431 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut1 (opt1)
  source 1..1834: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14432 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut1 (opt2)
  source 1..1834: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14433 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut1 (opt3)
  source 1..1834: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14434 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut1 (opt4)
  source 1..1834: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14435 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut1 (opt5)
  source 1..1834: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14436 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut1 (opt6)
  source 1..1834: mol_type = other RNA
gggagagcggctcggccattttgtcccagtcagtccggaggctgcggctgcagaagtaccgcctgcggagtaactgcaaagaagcttaccatggaattaccaatactaaaaacaaacgcaataacaacaattctagcagcagtaacattatgctttgcatcatcccaaaacatcacagaagaattttatcaatcaacctgctcagcagtttccaaaggatacttaggagcattaagaactggttggtacacttcagtaatcaccatcgaactctcaaacatcaaggaaaacaaatgcaacggaacagacgcaaaagttaaactcataaaacaagaacttgacaaatacaaaaacgccgtaacagaactacaacttctcatgcaatcaacacccgcagcaggatccggatcagccatatgctcaggcatagcagtatgtaaagtattacatcttgaaggtgaagtaaacaaaataaaaaacgcacttctatcaaccaacaaagcagtagtatcactatcaaacggagtatccgtcttaacatttaaagttctagacctcaaaaactatatagacaaacaattactgccaatcctcaataaacaatcatgctcaataccaaacatcgaaacagtaatagaatttcaacaaaaaaacaacagactactagaaataacaagagaattttccgtcaacgccggcgtaactactccagtatcaacatatatgctaaccaactcagaactcctatccctcataaacgacatgccaataactaatgatcaaaaaaaactaatgtcaaacaatgtacaaatagttagacaacaatcatactcaatcatgtgcataataaaagaagaagtactagcatacgtcgtccaactacccctatacggagtaatagacacaccttgctggaaactacacacatcacccctatgcacaacaaatacaaaagaaggttccaacatctgcctaacaagaactgatagaggatggtactgcgacaacgccggatcagtatcattcttccctcaagctgaaacctgcaaagtacaatcaaacagagtattttgcgatacaatgaactccctaacacttccctcagaagttaatctttgtaatatagatatattcaacccaaaatacgactgcaaaataatgacaagtaaaacagacgtatcctcatctgtaattacatcactaggagccatagtatcttgctacggcaaaaccaaatgcacagcatcaaacaaaaacagaggtattatcaaaaccttctcaaacggatgtgactacgtttcaaacaaaggagtagacacagtatcagtcggaaacaccctatactgtgttaacaaacaagaaggacaatcactgtacgtaaaaggagaacccataataaatttctacgacccacttgtatttccatcagacgaatttgatgcatcaatctcacaagtaaatgaaaaaataaaccaatcattagcattcataagaaaatctgacgagttactacacaacgtaaatgttggcaaatcaacaaccaatataatgataacaacaataataatagtaataatagtcatattactcctcctcatagccgtcggattattcttatactgcaaagcaagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14437 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut1 (opt11)
  source 1..1834: mol_type = other RNA
gggagagcggctcggccattttgtcccagtcagtccggaggctgcggctgcagaagtaccgcctgcggagtaactgcaaagaagcttaccatggaactccccatactaaaaaccaacgccatcacaacaatcctcgccgccgtcacactctgcttcgccagctcccaaaacatcaccgaagagttctatcaatcaacctgctccgcagtctcaaagggatacctcggagccctccgcaccggatggtacacttccgtcatcacaatagaactctccaacatcaaagaaaacaaatgcaacggcaccgacgcaaaagtcaagctcatcaaacaagaactcgacaaatataaaaacgccgtcaccgaactccaactactcatgcaatccacacccgcggccggctcaggcagcgccatctgctcaggcatcgccgtctgcaaagtcctccacctcgaaggcgaagtcaacaaaatcaaaaacgcccttctttcaaccaacaaggcagtagtatccctctcaaacggcgtcagcgtcctgaccttcaaagtcctagacctcaaaaactacatagataaacaactcctccccatactgaacaaacaatcgtgctccatccccaatatcgaaaccgtcatagagttccagcagaaaaacaacagacttctcgaaataacccgagagttctcagtaaacgccggagtcaccacacccgtaagcacctacatgctcacaaactcagaactcctatccctcatcaacgacatgcccatcaccaacgaccagaaaaagctaatgtccaacaacgtccaaatagtacgccaacaaagctactcgataatgtgcatcatcaaggaagaagtactcgcctacgtcgtccaactccccctctacggcgtaatcgacacaccctgctggaaactccacacgtccccactctgcacaacaaacacaaaagaaggatccaacatatgcctaacccgcaccgacaggggctggtactgcgacaacgcaggctcagtcagcttctttccccaagccgaaacatgcaaagtccaatccaaccgtgtcttctgcgacaccatgaactcgctcaccctaccctcggaagtcaatctctgcaacatcgacatcttcaacccaaaatacgactgtaaaatcatgaccagcaaaacagacgtttcttccagcgtcatcacatcactcggcgcgatcgtatcatgctatggcaaaacaaagtgcaccgctagcaataaaaaccgaggaatcataaaaaccttcagcaacggctgcgactacgtatccaacaaaggcgtcgacaccgtatccgtcggaaacaccctctactgcgtcaacaagcaagaaggacaatcactctacgtcaaaggcgaaccaatcataaacttctacgacccactcgtattcccctcagacgagttcgacgcatccatctcccaagtcaacgaaaagatcaaccaatctctcgcctttatacgcaaaagcgacgaactccttcacaacgtaaacgtcggcaaaagcaccactaacataatgatcaccacaatcataatagtaatcatcgtaatactcctcctactcatcgccgtgggcctattcctctattgcaaagcccgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14438 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut1 (opt1)
  source 1..1843: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14439 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut1 (opt1)
  source 1..1843: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14440 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut1 (opt2)
  source 1..1843: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14441 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut1 (opt3)
  source 1..1843: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14442 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut1 (opt4)
  source 1..1843: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14443 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut1 (opt5)
  source 1..1843: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14444 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut1 (opt6)
  source 1..1843: mol_type = other RNA
gggagacccgtgacccggaagttgtacggctacgcgactttccctcccacaaaccctcgcgcccttcctttcctacttgggcccggcagaaagcttaccatggaattaccaatactaaaaacaaacgcaataacaacaattctagcagcagtaacattatgctttgcatcatcccaaaacatcacagaagaattttatcaatcaacctgctcagcagtttccaaaggatacttaggagcattaagaactggttggtacacttcagtaatcaccatcgaactctcaaacatcaaggaaaacaaatgcaacggaacagacgcaaaagttaaactcataaaacaagaacttgacaaatacaaaaacgccgtaacagaactacaacttctcatgcaatcaacacccgcagcaggatccggatcagccatatgctcaggcatagcagtatgtaaagtattacatcttgaaggtgaagtaaacaaaataaaaaacgcacttctatcaaccaacaaagcagtagtatcactatcaaacggagtatccgtcttaacatttaaagttctagacctcaaaaactatatagacaaacaattactgccaatcctcaataaacaatcatgctcaataccaaacatcgaaacagtaatagaatttcaacaaaaaaacaacagactactagaaataacaagagaattttccgtcaacgccggcgtaactactccagtatcaacatatatgctaaccaactcagaactcctatccctcataaacgacatgccaataactaatgatcaaaaaaaactaatgtcaaacaatgtacaaatagttagacaacaatcatactcaatcatgtgcataataaaagaagaagtactagcatacgtcgtccaactacccctatacggagtaatagacacaccttgctggaaactacacacatcacccctatgcacaacaaatacaaaagaaggttccaacatctgcctaacaagaactgatagaggatggtactgcgacaacgccggatcagtatcattcttccctcaagctgaaacctgcaaagtacaatcaaacagagtattttgcgatacaatgaactccctaacacttccctcagaagttaatctttgtaatatagatatattcaacccaaaatacgactgcaaaataatgacaagtaaaacagacgtatcctcatctgtaattacatcactaggagccatagtatcttgctacggcaaaaccaaatgcacagcatcaaacaaaaacagaggtattatcaaaaccttctcaaacggatgtgactacgtttcaaacaaaggagtagacacagtatcagtcggaaacaccctatactgtgttaacaaacaagaaggacaatcactgtacgtaaaaggagaacccataataaatttctacgacccacttgtatttccatcagacgaatttgatgcatcaatctcacaagtaaatgaaaaaataaaccaatcattagcattcataagaaaatctgacgagttactacacaacgtaaatgttggcaaatcaacaaccaatataatgataacaacaataataatagtaataatagtcatattactcctcctcatagccgtcggattattcttatactgcaaagcaagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14445 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut1 (opt11)
  source 1..1843: mol_type = other RNA
gggagacccgtgacccggaagttgtacggctacgcgactttccctcccacaaaccctcgcgcccttcctttcctacttgggcccggcagaaagcttaccatggaactccccatactaaaaaccaacgccatcacaacaatcctcgccgccgtcacactctgcttcgccagctcccaaaacatcaccgaagagttctatcaatcaacctgctccgcagtctcaaagggatacctcggagccctccgcaccggatggtacacttccgtcatcacaatagaactctccaacatcaaagaaaacaaatgcaacggcaccgacgcaaaagtcaagctcatcaaacaagaactcgacaaatataaaaacgccgtcaccgaactccaactactcatgcaatccacacccgcggccggctcaggcagcgccatctgctcaggcatcgccgtctgcaaagtcctccacctcgaaggcgaagtcaacaaaatcaaaaacgcccttctttcaaccaacaaggcagtagtatccctctcaaacggcgtcagcgtcctgaccttcaaagtcctagacctcaaaaactacatagataaacaactcctccccatactgaacaaacaatcgtgctccatccccaatatcgaaaccgtcatagagttccagcagaaaaacaacagacttctcgaaataacccgagagttctcagtaaacgccggagtcaccacacccgtaagcacctacatgctcacaaactcagaactcctatccctcatcaacgacatgcccatcaccaacgaccagaaaaagctaatgtccaacaacgtccaaatagtacgccaacaaagctactcgataatgtgcatcatcaaggaagaagtactcgcctacgtcgtccaactccccctctacggcgtaatcgacacaccctgctggaaactccacacgtccccactctgcacaacaaacacaaaagaaggatccaacatatgcctaacccgcaccgacaggggctggtactgcgacaacgcaggctcagtcagcttctttccccaagccgaaacatgcaaagtccaatccaaccgtgtcttctgcgacaccatgaactcgctcaccctaccctcggaagtcaatctctgcaacatcgacatcttcaacccaaaatacgactgtaaaatcatgaccagcaaaacagacgtttcttccagcgtcatcacatcactcggcgcgatcgtatcatgctatggcaaaacaaagtgcaccgctagcaataaaaaccgaggaatcataaaaaccttcagcaacggctgcgactacgtatccaacaaaggcgtcgacaccgtatccgtcggaaacaccctctactgcgtcaacaagcaagaaggacaatcactctacgtcaaaggcgaaccaatcataaacttctacgacccactcgtattcccctcagacgagttcgacgcatccatctcccaagtcaacgaaaagatcaaccaatctctcgcctttatacgcaaaagcgacgaactccttcacaacgtaaacgtcggcaaaagcaccactaacataatgatcaccacaatcataatagtaatcatcgtaatactcctcctactcatcgccgtgggcctattcctctattgcaaagcccgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14446 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut1 (opt1)
  source 1..1898: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14447 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut1 (opt1)
  source 1..1898: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14448 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut1 (opt2)
  source 1..1898: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14449 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut1 (opt3)
  source 1..1898: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14450 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut1 (opt4)
  source 1..1898: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14451 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut1 (opt5)
  source 1..1898: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14452 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut1 (opt6)
  source 1..1898: mol_type = other RNA
gggagagcggctcggccattttgtcccagtcagtccggaggctgcggctgcagaagtaccgcctgcggagtaactgcaaagaagcttaccatggaattaccaatactaaaaacaaacgcaataacaacaattctagcagcagtaacattatgctttgcatcatcccaaaacatcacagaagaattttatcaatcaacctgctcagcagtttccaaaggatacttaggagcattaagaactggttggtacacttcagtaatcaccatcgaactctcaaacatcaaggaaaacaaatgcaacggaacagacgcaaaagttaaactcataaaacaagaacttgacaaatacaaaaacgccgtaacagaactacaacttctcatgcaatcaacacccgcagcaggatccggatcagccatatgctcaggcatagcagtatgtaaagtattacatcttgaaggtgaagtaaacaaaataaaaaacgcacttctatcaaccaacaaagcagtagtatcactatcaaacggagtatccgtcttaacatttaaagttctagacctcaaaaactatatagacaaacaattactgccaatcctcaataaacaatcatgctcaataccaaacatcgaaacagtaatagaatttcaacaaaaaaacaacagactactagaaataacaagagaattttccgtcaacgccggcgtaactactccagtatcaacatatatgctaaccaactcagaactcctatccctcataaacgacatgccaataactaatgatcaaaaaaaactaatgtcaaacaatgtacaaatagttagacaacaatcatactcaatcatgtgcataataaaagaagaagtactagcatacgtcgtccaactacccctatacggagtaatagacacaccttgctggaaactacacacatcacccctatgcacaacaaatacaaaagaaggttccaacatctgcctaacaagaactgatagaggatggtactgcgacaacgccggatcagtatcattcttccctcaagctgaaacctgcaaagtacaatcaaacagagtattttgcgatacaatgaactccctaacacttccctcagaagttaatctttgtaatatagatatattcaacccaaaatacgactgcaaaataatgacaagtaaaacagacgtatcctcatctgtaattacatcactaggagccatagtatcttgctacggcaaaaccaaatgcacagcatcaaacaaaaacagaggtattatcaaaaccttctcaaacggatgtgactacgtttcaaacaaaggagtagacacagtatcagtcggaaacaccctatactgtgttaacaaacaagaaggacaatcactgtacgtaaaaggagaacccataataaatttctacgacccacttgtatttccatcagacgaatttgatgcatcaatctcacaagtaaatgaaaaaataaaccaatcattagcattcataagaaaatctgacgagttactacacaacgtaaatgttggcaaatcaacaaccaatataatgataacaacaataataatagtaataatagtcatattactcctcctcatagccgtcggattattcttatactgcaaagcaagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14453 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut1 (opt11)
  source 1..1898: mol_type = other RNA
gggagagcggctcggccattttgtcccagtcagtccggaggctgcggctgcagaagtaccgcctgcggagtaactgcaaagaagcttaccatggaactccccatactaaaaaccaacgccatcacaacaatcctcgccgccgtcacactctgcttcgccagctcccaaaacatcaccgaagagttctatcaatcaacctgctccgcagtctcaaagggatacctcggagccctccgcaccggatggtacacttccgtcatcacaatagaactctccaacatcaaagaaaacaaatgcaacggcaccgacgcaaaagtcaagctcatcaaacaagaactcgacaaatataaaaacgccgtcaccgaactccaactactcatgcaatccacacccgcggccggctcaggcagcgccatctgctcaggcatcgccgtctgcaaagtcctccacctcgaaggcgaagtcaacaaaatcaaaaacgcccttctttcaaccaacaaggcagtagtatccctctcaaacggcgtcagcgtcctgaccttcaaagtcctagacctcaaaaactacatagataaacaactcctccccatactgaacaaacaatcgtgctccatccccaatatcgaaaccgtcatagagttccagcagaaaaacaacagacttctcgaaataacccgagagttctcagtaaacgccggagtcaccacacccgtaagcacctacatgctcacaaactcagaactcctatccctcatcaacgacatgcccatcaccaacgaccagaaaaagctaatgtccaacaacgtccaaatagtacgccaacaaagctactcgataatgtgcatcatcaaggaagaagtactcgcctacgtcgtccaactccccctctacggcgtaatcgacacaccctgctggaaactccacacgtccccactctgcacaacaaacacaaaagaaggatccaacatatgcctaacccgcaccgacaggggctggtactgcgacaacgcaggctcagtcagcttctttccccaagccgaaacatgcaaagtccaatccaaccgtgtcttctgcgacaccatgaactcgctcaccctaccctcggaagtcaatctctgcaacatcgacatcttcaacccaaaatacgactgtaaaatcatgaccagcaaaacagacgtttcttccagcgtcatcacatcactcggcgcgatcgtatcatgctatggcaaaacaaagtgcaccgctagcaataaaaaccgaggaatcataaaaaccttcagcaacggctgcgactacgtatccaacaaaggcgtcgacaccgtatccgtcggaaacaccctctactgcgtcaacaagcaagaaggacaatcactctacgtcaaaggcgaaccaatcataaacttctacgacccactcgtattcccctcagacgagttcgacgcatccatctcccaagtcaacgaaaagatcaaccaatctctcgcctttatacgcaaaagcgacgaactccttcacaacgtaaacgtcggcaaaagcaccactaacataatgatcaccacaatcataatagtaatcatcgtaatactcctcctactcatcgccgtgggcctattcctctattgcaaagcccgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14454 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut1 (opt1)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14455 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut1 (opt1)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14456 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut1 (opt2)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14457 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut1 (opt3)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14458 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut1 (opt4)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14459 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut1 (opt5)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14460 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut1 (opt6)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattaccaatactaaaaacaaacgcaataacaacaattctagcagcagtaacattatgctttgcatcatcccaaaacatcacagaagaattttatcaatcaacctgctcagcagtttccaaaggatacttaggagcattaagaactggttggtacacttcagtaatcaccatcgaactctcaaacatcaaggaaaacaaatgcaacggaacagacgcaaaagttaaactcataaaacaagaacttgacaaatacaaaaacgccgtaacagaactacaacttctcatgcaatcaacacccgcagcaggatccggatcagccatatgctcaggcatagcagtatgtaaagtattacatcttgaaggtgaagtaaacaaaataaaaaacgcacttctatcaaccaacaaagcagtagtatcactatcaaacggagtatccgtcttaacatttaaagttctagacctcaaaaactatatagacaaacaattactgccaatcctcaataaacaatcatgctcaataccaaacatcgaaacagtaatagaatttcaacaaaaaaacaacagactactagaaataacaagagaattttccgtcaacgccggcgtaactactccagtatcaacatatatgctaaccaactcagaactcctatccctcataaacgacatgccaataactaatgatcaaaaaaaactaatgtcaaacaatgtacaaatagttagacaacaatcatactcaatcatgtgcataataaaagaagaagtactagcatacgtcgtccaactacccctatacggagtaatagacacaccttgctggaaactacacacatcacccctatgcacaacaaatacaaaagaaggttccaacatctgcctaacaagaactgatagaggatggtactgcgacaacgccggatcagtatcattcttccctcaagctgaaacctgcaaagtacaatcaaacagagtattttgcgatacaatgaactccctaacacttccctcagaagttaatctttgtaatatagatatattcaacccaaaatacgactgcaaaataatgacaagtaaaacagacgtatcctcatctgtaattacatcactaggagccatagtatcttgctacggcaaaaccaaatgcacagcatcaaacaaaaacagaggtattatcaaaaccttctcaaacggatgtgactacgtttcaaacaaaggagtagacacagtatcagtcggaaacaccctatactgtgttaacaaacaagaaggacaatcactgtacgtaaaaggagaacccataataaatttctacgacccacttgtatttccatcagacgaatttgatgcatcaatctcacaagtaaatgaaaaaataaaccaatcattagcattcataagaaaatctgacgagttactacacaacgtaaatgttggcaaatcaacaaccaatataatgataacaacaataataatagtaataatagtcatattactcctcctcatagccgtcggattattcttatactgcaaagcaagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14461 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut1 (opt11)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatactaaaaaccaacgccatcacaacaatcctcgccgccgtcacactctgcttcgccagctcccaaaacatcaccgaagagttctatcaatcaacctgctccgcagtctcaaagggatacctcggagccctccgcaccggatggtacacttccgtcatcacaatagaactctccaacatcaaagaaaacaaatgcaacggcaccgacgcaaaagtcaagctcatcaaacaagaactcgacaaatataaaaacgccgtcaccgaactccaactactcatgcaatccacacccgcggccggctcaggcagcgccatctgctcaggcatcgccgtctgcaaagtcctccacctcgaaggcgaagtcaacaaaatcaaaaacgcccttctttcaaccaacaaggcagtagtatccctctcaaacggcgtcagcgtcctgaccttcaaagtcctagacctcaaaaactacatagataaacaactcctccccatactgaacaaacaatcgtgctccatccccaatatcgaaaccgtcatagagttccagcagaaaaacaacagacttctcgaaataacccgagagttctcagtaaacgccggagtcaccacacccgtaagcacctacatgctcacaaactcagaactcctatccctcatcaacgacatgcccatcaccaacgaccagaaaaagctaatgtccaacaacgtccaaatagtacgccaacaaagctactcgataatgtgcatcatcaaggaagaagtactcgcctacgtcgtccaactccccctctacggcgtaatcgacacaccctgctggaaactccacacgtccccactctgcacaacaaacacaaaagaaggatccaacatatgcctaacccgcaccgacaggggctggtactgcgacaacgcaggctcagtcagcttctttccccaagccgaaacatgcaaagtccaatccaaccgtgtcttctgcgacaccatgaactcgctcaccctaccctcggaagtcaatctctgcaacatcgacatcttcaacccaaaatacgactgtaaaatcatgaccagcaaaacagacgtttcttccagcgtcatcacatcactcggcgcgatcgtatcatgctatggcaaaacaaagtgcaccgctagcaataaaaaccgaggaatcataaaaaccttcagcaacggctgcgactacgtatccaacaaaggcgtcgacaccgtatccgtcggaaacaccctctactgcgtcaacaagcaagaaggacaatcactctacgtcaaaggcgaaccaatcataaacttctacgacccactcgtattcccctcagacgagttcgacgcatccatctcccaagtcaacgaaaagatcaaccaatctctcgcctttatacgcaaaagcgacgaactccttcacaacgtaaacgtcggcaaaagcaccactaacataatgatcaccacaatcataatagtaatcatcgtaatactcctcctactcatcgccgtgggcctattcctctattgcaaagcccgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14462 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut1 (opt1)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14463 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut1 (opt1)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14464 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut1 (opt2)
  source 1..1897: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14465 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut1 (opt3)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14466 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut1 (opt4)
  source 1..1897: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14467 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut1 (opt5)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14468 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut1 (opt6)
  source 1..1897: mol_type = other RNA
gggagagtcccgcagtcggcgtccagcggctctgcttgttcgtgtgtgtgtcgttgcaggccttattcaagcttaccatggaattaccaatactaaaaacaaacgcaataacaacaattctagcagcagtaacattatgctttgcatcatcccaaaacatcacagaagaattttatcaatcaacctgctcagcagtttccaaaggatacttaggagcattaagaactggttggtacacttcagtaatcaccatcgaactctcaaacatcaaggaaaacaaatgcaacggaacagacgcaaaagttaaactcataaaacaagaacttgacaaatacaaaaacgccgtaacagaactacaacttctcatgcaatcaacacccgcagcaggatccggatcagccatatgctcaggcatagcagtatgtaaagtattacatcttgaaggtgaagtaaacaaaataaaaaacgcacttctatcaaccaacaaagcagtagtatcactatcaaacggagtatccgtcttaacatttaaagttctagacctcaaaaactatatagacaaacaattactgccaatcctcaataaacaatcatgctcaataccaaacatcgaaacagtaatagaatttcaacaaaaaaacaacagactactagaaataacaagagaattttccgtcaacgccggcgtaactactccagtatcaacatatatgctaaccaactcagaactcctatccctcataaacgacatgccaataactaatgatcaaaaaaaactaatgtcaaacaatgtacaaatagttagacaacaatcatactcaatcatgtgcataataaaagaagaagtactagcatacgtcgtccaactacccctatacggagtaatagacacaccttgctggaaactacacacatcacccctatgcacaacaaatacaaaagaaggttccaacatctgcctaacaagaactgatagaggatggtactgcgacaacgccggatcagtatcattcttccctcaagctgaaacctgcaaagtacaatcaaacagagtattttgcgatacaatgaactccctaacacttccctcagaagttaatctttgtaatatagatatattcaacccaaaatacgactgcaaaataatgacaagtaaaacagacgtatcctcatctgtaattacatcactaggagccatagtatcttgctacggcaaaaccaaatgcacagcatcaaacaaaaacagaggtattatcaaaaccttctcaaacggatgtgactacgtttcaaacaaaggagtagacacagtatcagtcggaaacaccctatactgtgttaacaaacaagaaggacaatcactgtacgtaaaaggagaacccataataaatttctacgacccacttgtatttccatcagacgaatttgatgcatcaatctcacaagtaaatgaaaaaataaaccaatcattagcattcataagaaaatctgacgagttactacacaacgtaaatgttggcaaatcaacaaccaatataatgataacaacaataataatagtaataatagtcatattactcctcctcatagccgtcggattattcttatactgcaaagcaagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14469 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut1 (opt11)
  source 1..1897: mol_type = other RNA
gggagagtcccgcagtcggcgtccagcggctctgcttgttcgtgtgtgtgtcgttgcaggccttattcaagcttaccatggaactccccatactaaaaaccaacgccatcacaacaatcctcgccgccgtcacactctgcttcgccagctcccaaaacatcaccgaagagttctatcaatcaacctgctccgcagtctcaaagggatacctcggagccctccgcaccggatggtacacttccgtcatcacaatagaactctccaacatcaaagaaaacaaatgcaacggcaccgacgcaaaagtcaagctcatcaaacaagaactcgacaaatataaaaacgccgtcaccgaactccaactactcatgcaatccacacccgcggccggctcaggcagcgccatctgctcaggcatcgccgtctgcaaagtcctccacctcgaaggcgaagtcaacaaaatcaaaaacgcccttctttcaaccaacaaggcagtagtatccctctcaaacggcgtcagcgtcctgaccttcaaagtcctagacctcaaaaactacatagataaacaactcctccccatactgaacaaacaatcgtgctccatccccaatatcgaaaccgtcatagagttccagcagaaaaacaacagacttctcgaaataacccgagagttctcagtaaacgccggagtcaccacacccgtaagcacctacatgctcacaaactcagaactcctatccctcatcaacgacatgcccatcaccaacgaccagaaaaagctaatgtccaacaacgtccaaatagtacgccaacaaagctactcgataatgtgcatcatcaaggaagaagtactcgcctacgtcgtccaactccccctctacggcgtaatcgacacaccctgctggaaactccacacgtccccactctgcacaacaaacacaaaagaaggatccaacatatgcctaacccgcaccgacaggggctggtactgcgacaacgcaggctcagtcagcttctttccccaagccgaaacatgcaaagtccaatccaaccgtgtcttctgcgacaccatgaactcgctcaccctaccctcggaagtcaatctctgcaacatcgacatcttcaacccaaaatacgactgtaaaatcatgaccagcaaaacagacgtttcttccagcgtcatcacatcactcggcgcgatcgtatcatgctatggcaaaacaaagtgcaccgctagcaataaaaaccgaggaatcataaaaaccttcagcaacggctgcgactacgtatccaacaaaggcgtcgacaccgtatccgtcggaaacaccctctactgcgtcaacaagcaagaaggacaatcactctacgtcaaaggcgaaccaatcataaacttctacgacccactcgtattcccctcagacgagttcgacgcatccatctcccaagtcaacgaaaagatcaaccaatctctcgcctttatacgcaaaagcgacgaactccttcacaacgtaaacgtcggcaaaagcaccactaacataatgatcaccacaatcataatagtaatcatcgtaatactcctcctactcatcgccgtgggcctattcctctattgcaaagcccgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14470 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut1 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14471 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut1 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14472 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut1 (opt2)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14473 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut1 (opt3)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14474 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut1 (opt4)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14475 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut1 (opt5)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14476 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut1 (opt6)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattaccaatactaaaaacaaacgcaataacaacaattctagcagcagtaacattatgctttgcatcatcccaaaacatcacagaagaattttatcaatcaacctgctcagcagtttccaaaggatacttaggagcattaagaactggttggtacacttcagtaatcaccatcgaactctcaaacatcaaggaaaacaaatgcaacggaacagacgcaaaagttaaactcataaaacaagaacttgacaaatacaaaaacgccgtaacagaactacaacttctcatgcaatcaacacccgcagcaggatccggatcagccatatgctcaggcatagcagtatgtaaagtattacatcttgaaggtgaagtaaacaaaataaaaaacgcacttctatcaaccaacaaagcagtagtatcactatcaaacggagtatccgtcttaacatttaaagttctagacctcaaaaactatatagacaaacaattactgccaatcctcaataaacaatcatgctcaataccaaacatcgaaacagtaatagaatttcaacaaaaaaacaacagactactagaaataacaagagaattttccgtcaacgccggcgtaactactccagtatcaacatatatgctaaccaactcagaactcctatccctcataaacgacatgccaataactaatgatcaaaaaaaactaatgtcaaacaatgtacaaatagttagacaacaatcatactcaatcatgtgcataataaaagaagaagtactagcatacgtcgtccaactacccctatacggagtaatagacacaccttgctggaaactacacacatcacccctatgcacaacaaatacaaaagaaggttccaacatctgcctaacaagaactgatagaggatggtactgcgacaacgccggatcagtatcattcttccctcaagctgaaacctgcaaagtacaatcaaacagagtattttgcgatacaatgaactccctaacacttccctcagaagttaatctttgtaatatagatatattcaacccaaaatacgactgcaaaataatgacaagtaaaacagacgtatcctcatctgtaattacatcactaggagccatagtatcttgctacggcaaaaccaaatgcacagcatcaaacaaaaacagaggtattatcaaaaccttctcaaacggatgtgactacgtttcaaacaaaggagtagacacagtatcagtcggaaacaccctatactgtgttaacaaacaagaaggacaatcactgtacgtaaaaggagaacccataataaatttctacgacccacttgtatttccatcagacgaatttgatgcatcaatctcacaagtaaatgaaaaaataaaccaatcattagcattcataagaaaatctgacgagttactacacaacgtaaatgttggcaaatcaacaaccaatataatgataacaacaataataatagtaataatagtcatattactcctcctcatagccgtcggattattcttatactgcaaagcaagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14477 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut1 (opt11)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatactaaaaaccaacgccatcacaacaatcctcgccgccgtcacactctgcttcgccagctcccaaaacatcaccgaagagttctatcaatcaacctgctccgcagtctcaaagggatacctcggagccctccgcaccggatggtacacttccgtcatcacaatagaactctccaacatcaaagaaaacaaatgcaacggcaccgacgcaaaagtcaagctcatcaaacaagaactcgacaaatataaaaacgccgtcaccgaactccaactactcatgcaatccacacccgcggccggctcaggcagcgccatctgctcaggcatcgccgtctgcaaagtcctccacctcgaaggcgaagtcaacaaaatcaaaaacgcccttctttcaaccaacaaggcagtagtatccctctcaaacggcgtcagcgtcctgaccttcaaagtcctagacctcaaaaactacatagataaacaactcctccccatactgaacaaacaatcgtgctccatccccaatatcgaaaccgtcatagagttccagcagaaaaacaacagacttctcgaaataacccgagagttctcagtaaacgccggagtcaccacacccgtaagcacctacatgctcacaaactcagaactcctatccctcatcaacgacatgcccatcaccaacgaccagaaaaagctaatgtccaacaacgtccaaatagtacgccaacaaagctactcgataatgtgcatcatcaaggaagaagtactcgcctacgtcgtccaactccccctctacggcgtaatcgacacaccctgctggaaactccacacgtccccactctgcacaacaaacacaaaagaaggatccaacatatgcctaacccgcaccgacaggggctggtactgcgacaacgcaggctcagtcagcttctttccccaagccgaaacatgcaaagtccaatccaaccgtgtcttctgcgacaccatgaactcgctcaccctaccctcggaagtcaatctctgcaacatcgacatcttcaacccaaaatacgactgtaaaatcatgaccagcaaaacagacgtttcttccagcgtcatcacatcactcggcgcgatcgtatcatgctatggcaaaacaaagtgcaccgctagcaataaaaaccgaggaatcataaaaaccttcagcaacggctgcgactacgtatccaacaaaggcgtcgacaccgtatccgtcggaaacaccctctactgcgtcaacaagcaagaaggacaatcactctacgtcaaaggcgaaccaatcataaacttctacgacccactcgtattcccctcagacgagttcgacgcatccatctcccaagtcaacgaaaagatcaaccaatctctcgcctttatacgcaaaagcgacgaactccttcacaacgtaaacgtcggcaaaagcaccactaacataatgatcaccacaatcataatagtaatcatcgtaatactcctcctactcatcgccgtgggcctattcctctattgcaaagcccgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14478 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut1 (opt1)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14479 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut1 (opt1)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14480 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut1 (opt2)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14481 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut1 (opt3)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14482 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut1 (opt4)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14483 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut1 (opt5)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14484 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut1 (opt6)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaattaccaatactaaaaacaaacgcaataacaacaattctagcagcagtaacattatgctttgcatcatcccaaaacatcacagaagaattttatcaatcaacctgctcagcagtttccaaaggatacttaggagcattaagaactggttggtacacttcagtaatcaccatcgaactctcaaacatcaaggaaaacaaatgcaacggaacagacgcaaaagttaaactcataaaacaagaacttgacaaatacaaaaacgccgtaacagaactacaacttctcatgcaatcaacacccgcagcaggatccggatcagccatatgctcaggcatagcagtatgtaaagtattacatcttgaaggtgaagtaaacaaaataaaaaacgcacttctatcaaccaacaaagcagtagtatcactatcaaacggagtatccgtcttaacatttaaagttctagacctcaaaaactatatagacaaacaattactgccaatcctcaataaacaatcatgctcaataccaaacatcgaaacagtaatagaatttcaacaaaaaaacaacagactactagaaataacaagagaattttccgtcaacgccggcgtaactactccagtatcaacatatatgctaaccaactcagaactcctatccctcataaacgacatgccaataactaatgatcaaaaaaaactaatgtcaaacaatgtacaaatagttagacaacaatcatactcaatcatgtgcataataaaagaagaagtactagcatacgtcgtccaactacccctatacggagtaatagacacaccttgctggaaactacacacatcacccctatgcacaacaaatacaaaagaaggttccaacatctgcctaacaagaactgatagaggatggtactgcgacaacgccggatcagtatcattcttccctcaagctgaaacctgcaaagtacaatcaaacagagtattttgcgatacaatgaactccctaacacttccctcagaagttaatctttgtaatatagatatattcaacccaaaatacgactgcaaaataatgacaagtaaaacagacgtatcctcatctgtaattacatcactaggagccatagtatcttgctacggcaaaaccaaatgcacagcatcaaacaaaaacagaggtattatcaaaaccttctcaaacggatgtgactacgtttcaaacaaaggagtagacacagtatcagtcggaaacaccctatactgtgttaacaaacaagaaggacaatcactgtacgtaaaaggagaacccataataaatttctacgacccacttgtatttccatcagacgaatttgatgcatcaatctcacaagtaaatgaaaaaataaaccaatcattagcattcataagaaaatctgacgagttactacacaacgtaaatgttggcaaatcaacaaccaatataatgataacaacaataataatagtaataatagtcatattactcctcctcatagccgtcggattattcttatactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14485 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut1 (opt11)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactccccatactaaaaaccaacgccatcacaacaatcctcgccgccgtcacactctgcttcgccagctcccaaaacatcaccgaagagttctatcaatcaacctgctccgcagtctcaaagggatacctcggagccctccgcaccggatggtacacttccgtcatcacaatagaactctccaacatcaaagaaaacaaatgcaacggcaccgacgcaaaagtcaagctcatcaaacaagaactcgacaaatataaaaacgccgtcaccgaactccaactactcatgcaatccacacccgcggccggctcaggcagcgccatctgctcaggcatcgccgtctgcaaagtcctccacctcgaaggcgaagtcaacaaaatcaaaaacgcccttctttcaaccaacaaggcagtagtatccctctcaaacggcgtcagcgtcctgaccttcaaagtcctagacctcaaaaactacatagataaacaactcctccccatactgaacaaacaatcgtgctccatccccaatatcgaaaccgtcatagagttccagcagaaaaacaacagacttctcgaaataacccgagagttctcagtaaacgccggagtcaccacacccgtaagcacctacatgctcacaaactcagaactcctatccctcatcaacgacatgcccatcaccaacgaccagaaaaagctaatgtccaacaacgtccaaatagtacgccaacaaagctactcgataatgtgcatcatcaaggaagaagtactcgcctacgtcgtccaactccccctctacggcgtaatcgacacaccctgctggaaactccacacgtccccactctgcacaacaaacacaaaagaaggatccaacatatgcctaacccgcaccgacaggggctggtactgcgacaacgcaggctcagtcagcttctttccccaagccgaaacatgcaaagtccaatccaaccgtgtcttctgcgacaccatgaactcgctcaccctaccctcggaagtcaatctctgcaacatcgacatcttcaacccaaaatacgactgtaaaatcatgaccagcaaaacagacgtttcttccagcgtcatcacatcactcggcgcgatcgtatcatgctatggcaaaacaaagtgcaccgctagcaataaaaaccgaggaatcataaaaaccttcagcaacggctgcgactacgtatccaacaaaggcgtcgacaccgtatccgtcggaaacaccctctactgcgtcaacaagcaagaaggacaatcactctacgtcaaaggcgaaccaatcataaacttctacgacccactcgtattcccctcagacgagttcgacgcatccatctcccaagtcaacgaaaagatcaaccaatctctcgcctttatacgcaaaagcgacgaactccttcacaacgtaaacgtcggcaaaagcaccactaacataatgatcaccacaatcataatagtaatcatcgtaatactcctcctactcatcgccgtgggcctattcctctattgcaaagcccgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14486 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut1 (opt1)
  source 1..1856: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14487 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut1 (opt1)
  source 1..1856: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14488 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut1 (opt2)
  source 1..1856: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14489 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut1 (opt3)
  source 1..1856: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14490 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut1 (opt4)
  source 1..1856: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14491 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut1 (opt5)
  source 1..1856: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14492 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut1 (opt6)
  source 1..1856: mol_type = other RNA
gggagacccgtgacccggaagttgtacggctacgcgactttccctcccacaaaccctcgcgcccttcctttcctacttgggcccggcagaaagcttaccatggaattaccaatactaaaaacaaacgcaataacaacaattctagcagcagtaacattatgctttgcatcatcccaaaacatcacagaagaattttatcaatcaacctgctcagcagtttccaaaggatacttaggagcattaagaactggttggtacacttcagtaatcaccatcgaactctcaaacatcaaggaaaacaaatgcaacggaacagacgcaaaagttaaactcataaaacaagaacttgacaaatacaaaaacgccgtaacagaactacaacttctcatgcaatcaacacccgcagcaggatccggatcagccatatgctcaggcatagcagtatgtaaagtattacatcttgaaggtgaagtaaacaaaataaaaaacgcacttctatcaaccaacaaagcagtagtatcactatcaaacggagtatccgtcttaacatttaaagttctagacctcaaaaactatatagacaaacaattactgccaatcctcaataaacaatcatgctcaataccaaacatcgaaacagtaatagaatttcaacaaaaaaacaacagactactagaaataacaagagaattttccgtcaacgccggcgtaactactccagtatcaacatatatgctaaccaactcagaactcctatccctcataaacgacatgccaataactaatgatcaaaaaaaactaatgtcaaacaatgtacaaatagttagacaacaatcatactcaatcatgtgcataataaaagaagaagtactagcatacgtcgtccaactacccctatacggagtaatagacacaccttgctggaaactacacacatcacccctatgcacaacaaatacaaaagaaggttccaacatctgcctaacaagaactgatagaggatggtactgcgacaacgccggatcagtatcattcttccctcaagctgaaacctgcaaagtacaatcaaacagagtattttgcgatacaatgaactccctaacacttccctcagaagttaatctttgtaatatagatatattcaacccaaaatacgactgcaaaataatgacaagtaaaacagacgtatcctcatctgtaattacatcactaggagccatagtatcttgctacggcaaaaccaaatgcacagcatcaaacaaaaacagaggtattatcaaaaccttctcaaacggatgtgactacgtttcaaacaaaggagtagacacagtatcagtcggaaacaccctatactgtgttaacaaacaagaaggacaatcactgtacgtaaaaggagaacccataataaatttctacgacccacttgtatttccatcagacgaatttgatgcatcaatctcacaagtaaatgaaaaaataaaccaatcattagcattcataagaaaatctgacgagttactacacaacgtaaatgttggcaaatcaacaaccaatataatgataacaacaataataatagtaataatagtcatattactcctcctcatagccgtcggattattcttatactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14493 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut1 (opt11)
  source 1..1856: mol_type = other RNA
gggagacccgtgacccggaagttgtacggctacgcgactttccctcccacaaaccctcgcgcccttcctttcctacttgggcccggcagaaagcttaccatggaactccccatactaaaaaccaacgccatcacaacaatcctcgccgccgtcacactctgcttcgccagctcccaaaacatcaccgaagagttctatcaatcaacctgctccgcagtctcaaagggatacctcggagccctccgcaccggatggtacacttccgtcatcacaatagaactctccaacatcaaagaaaacaaatgcaacggcaccgacgcaaaagtcaagctcatcaaacaagaactcgacaaatataaaaacgccgtcaccgaactccaactactcatgcaatccacacccgcggccggctcaggcagcgccatctgctcaggcatcgccgtctgcaaagtcctccacctcgaaggcgaagtcaacaaaatcaaaaacgcccttctttcaaccaacaaggcagtagtatccctctcaaacggcgtcagcgtcctgaccttcaaagtcctagacctcaaaaactacatagataaacaactcctccccatactgaacaaacaatcgtgctccatccccaatatcgaaaccgtcatagagttccagcagaaaaacaacagacttctcgaaataacccgagagttctcagtaaacgccggagtcaccacacccgtaagcacctacatgctcacaaactcagaactcctatccctcatcaacgacatgcccatcaccaacgaccagaaaaagctaatgtccaacaacgtccaaatagtacgccaacaaagctactcgataatgtgcatcatcaaggaagaagtactcgcctacgtcgtccaactccccctctacggcgtaatcgacacaccctgctggaaactccacacgtccccactctgcacaacaaacacaaaagaaggatccaacatatgcctaacccgcaccgacaggggctggtactgcgacaacgcaggctcagtcagcttctttccccaagccgaaacatgcaaagtccaatccaaccgtgtcttctgcgacaccatgaactcgctcaccctaccctcggaagtcaatctctgcaacatcgacatcttcaacccaaaatacgactgtaaaatcatgaccagcaaaacagacgtttcttccagcgtcatcacatcactcggcgcgatcgtatcatgctatggcaaaacaaagtgcaccgctagcaataaaaaccgaggaatcataaaaaccttcagcaacggctgcgactacgtatccaacaaaggcgtcgacaccgtatccgtcggaaacaccctctactgcgtcaacaagcaagaaggacaatcactctacgtcaaaggcgaaccaatcataaacttctacgacccactcgtattcccctcagacgagttcgacgcatccatctcccaagtcaacgaaaagatcaaccaatctctcgcctttatacgcaaaagcgacgaactccttcacaacgtaaacgtcggcaaaagcaccactaacataatgatcaccacaatcataatagtaatcatcgtaatactcctcctactcatcgccgtgggcctattcctctattgcaaagcccgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14494 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut1 (opt1)
  source 1..1826: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14495 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut1 (opt1)
  source 1..1826: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14496 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut1 (opt2)
  source 1..1826: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14497 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut1 (opt3)
  source 1..1826: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14498 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut1 (opt4)
  source 1..1826: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14499 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut1 (opt5)
  source 1..1826: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14500 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut1 (opt6)
  source 1..1826: mol_type = other RNA
gggagactttcccattctgtagcagaatttggtgttgcctgtggtcttggtcccgcggagaagcttaccatggaattaccaatactaaaaacaaacgcaataacaacaattctagcagcagtaacattatgctttgcatcatcccaaaacatcacagaagaattttatcaatcaacctgctcagcagtttccaaaggatacttaggagcattaagaactggttggtacacttcagtaatcaccatcgaactctcaaacatcaaggaaaacaaatgcaacggaacagacgcaaaagttaaactcataaaacaagaacttgacaaatacaaaaacgccgtaacagaactacaacttctcatgcaatcaacacccgcagcaggatccggatcagccatatgctcaggcatagcagtatgtaaagtattacatcttgaaggtgaagtaaacaaaataaaaaacgcacttctatcaaccaacaaagcagtagtatcactatcaaacggagtatccgtcttaacatttaaagttctagacctcaaaaactatatagacaaacaattactgccaatcctcaataaacaatcatgctcaataccaaacatcgaaacagtaatagaatttcaacaaaaaaacaacagactactagaaataacaagagaattttccgtcaacgccggcgtaactactccagtatcaacatatatgctaaccaactcagaactcctatccctcataaacgacatgccaataactaatgatcaaaaaaaactaatgtcaaacaatgtacaaatagttagacaacaatcatactcaatcatgtgcataataaaagaagaagtactagcatacgtcgtccaactacccctatacggagtaatagacacaccttgctggaaactacacacatcacccctatgcacaacaaatacaaaagaaggttccaacatctgcctaacaagaactgatagaggatggtactgcgacaacgccggatcagtatcattcttccctcaagctgaaacctgcaaagtacaatcaaacagagtattttgcgatacaatgaactccctaacacttccctcagaagttaatctttgtaatatagatatattcaacccaaaatacgactgcaaaataatgacaagtaaaacagacgtatcctcatctgtaattacatcactaggagccatagtatcttgctacggcaaaaccaaatgcacagcatcaaacaaaaacagaggtattatcaaaaccttctcaaacggatgtgactacgtttcaaacaaaggagtagacacagtatcagtcggaaacaccctatactgtgttaacaaacaagaaggacaatcactgtacgtaaaaggagaacccataataaatttctacgacccacttgtatttccatcagacgaatttgatgcatcaatctcacaagtaaatgaaaaaataaaccaatcattagcattcataagaaaatctgacgagttactacacaacgtaaatgttggcaaatcaacaaccaatataatgataacaacaataataatagtaataatagtcatattactcctcctcatagccgtcggattattcttatactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14501 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut1 (opt11)
  source 1..1826: mol_type = other RNA
gggagactttcccattctgtagcagaatttggtgttgcctgtggtcttggtcccgcggagaagcttaccatggaactccccatactaaaaaccaacgccatcacaacaatcctcgccgccgtcacactctgcttcgccagctcccaaaacatcaccgaagagttctatcaatcaacctgctccgcagtctcaaagggatacctcggagccctccgcaccggatggtacacttccgtcatcacaatagaactctccaacatcaaagaaaacaaatgcaacggcaccgacgcaaaagtcaagctcatcaaacaagaactcgacaaatataaaaacgccgtcaccgaactccaactactcatgcaatccacacccgcggccggctcaggcagcgccatctgctcaggcatcgccgtctgcaaagtcctccacctcgaaggcgaagtcaacaaaatcaaaaacgcccttctttcaaccaacaaggcagtagtatccctctcaaacggcgtcagcgtcctgaccttcaaagtcctagacctcaaaaactacatagataaacaactcctccccatactgaacaaacaatcgtgctccatccccaatatcgaaaccgtcatagagttccagcagaaaaacaacagacttctcgaaataacccgagagttctcagtaaacgccggagtcaccacacccgtaagcacctacatgctcacaaactcagaactcctatccctcatcaacgacatgcccatcaccaacgaccagaaaaagctaatgtccaacaacgtccaaatagtacgccaacaaagctactcgataatgtgcatcatcaaggaagaagtactcgcctacgtcgtccaactccccctctacggcgtaatcgacacaccctgctggaaactccacacgtccccactctgcacaacaaacacaaaagaaggatccaacatatgcctaacccgcaccgacaggggctggtactgcgacaacgcaggctcagtcagcttctttccccaagccgaaacatgcaaagtccaatccaaccgtgtcttctgcgacaccatgaactcgctcaccctaccctcggaagtcaatctctgcaacatcgacatcttcaacccaaaatacgactgtaaaatcatgaccagcaaaacagacgtttcttccagcgtcatcacatcactcggcgcgatcgtatcatgctatggcaaaacaaagtgcaccgctagcaataaaaaccgaggaatcataaaaaccttcagcaacggctgcgactacgtatccaacaaaggcgtcgacaccgtatccgtcggaaacaccctctactgcgtcaacaagcaagaaggacaatcactctacgtcaaaggcgaaccaatcataaacttctacgacccactcgtattcccctcagacgagttcgacgcatccatctcccaagtcaacgaaaagatcaaccaatctctcgcctttatacgcaaaagcgacgaactccttcacaacgtaaacgtcggcaaaagcaccactaacataatgatcaccacaatcataatagtaatcatcgtaatactcctcctactcatcgccgtgggcctattcctctattgcaaagcccgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14502 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut1 (opt1)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14503 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut1 (opt1)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14504 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut1 (opt2)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14505 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut1 (opt3)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14506 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut1 (opt4)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14507 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut1 (opt5)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14508 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut1 (opt6)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattaccaatactaaaaacaaacgcaataacaacaattctagcagcagtaacattatgctttgcatcatcccaaaacatcacagaagaattttatcaatcaacctgctcagcagtttccaaaggatacttaggagcattaagaactggttggtacacttcagtaatcaccatcgaactctcaaacatcaaggaaaacaaatgcaacggaacagacgcaaaagttaaactcataaaacaagaacttgacaaatacaaaaacgccgtaacagaactacaacttctcatgcaatcaacacccgcagcaggatccggatcagccatatgctcaggcatagcagtatgtaaagtattacatcttgaaggtgaagtaaacaaaataaaaaacgcacttctatcaaccaacaaagcagtagtatcactatcaaacggagtatccgtcttaacatttaaagttctagacctcaaaaactatatagacaaacaattactgccaatcctcaataaacaatcatgctcaataccaaacatcgaaacagtaatagaatttcaacaaaaaaacaacagactactagaaataacaagagaattttccgtcaacgccggcgtaactactccagtatcaacatatatgctaaccaactcagaactcctatccctcataaacgacatgccaataactaatgatcaaaaaaaactaatgtcaaacaatgtacaaatagttagacaacaatcatactcaatcatgtgcataataaaagaagaagtactagcatacgtcgtccaactacccctatacggagtaatagacacaccttgctggaaactacacacatcacccctatgcacaacaaatacaaaagaaggttccaacatctgcctaacaagaactgatagaggatggtactgcgacaacgccggatcagtatcattcttccctcaagctgaaacctgcaaagtacaatcaaacagagtattttgcgatacaatgaactccctaacacttccctcagaagttaatctttgtaatatagatatattcaacccaaaatacgactgcaaaataatgacaagtaaaacagacgtatcctcatctgtaattacatcactaggagccatagtatcttgctacggcaaaaccaaatgcacagcatcaaacaaaaacagaggtattatcaaaaccttctcaaacggatgtgactacgtttcaaacaaaggagtagacacagtatcagtcggaaacaccctatactgtgttaacaaacaagaaggacaatcactgtacgtaaaaggagaacccataataaatttctacgacccacttgtatttccatcagacgaatttgatgcatcaatctcacaagtaaatgaaaaaataaaccaatcattagcattcataagaaaatctgacgagttactacacaacgtaaatgttggcaaatcaacaaccaatataatgataacaacaataataatagtaataatagtcatattactcctcctcatagccgtcggattattcttatactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14509 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut1 (opt11)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactccccatactaaaaaccaacgccatcacaacaatcctcgccgccgtcacactctgcttcgccagctcccaaaacatcaccgaagagttctatcaatcaacctgctccgcagtctcaaagggatacctcggagccctccgcaccggatggtacacttccgtcatcacaatagaactctccaacatcaaagaaaacaaatgcaacggcaccgacgcaaaagtcaagctcatcaaacaagaactcgacaaatataaaaacgccgtcaccgaactccaactactcatgcaatccacacccgcggccggctcaggcagcgccatctgctcaggcatcgccgtctgcaaagtcctccacctcgaaggcgaagtcaacaaaatcaaaaacgcccttctttcaaccaacaaggcagtagtatccctctcaaacggcgtcagcgtcctgaccttcaaagtcctagacctcaaaaactacatagataaacaactcctccccatactgaacaaacaatcgtgctccatccccaatatcgaaaccgtcatagagttccagcagaaaaacaacagacttctcgaaataacccgagagttctcagtaaacgccggagtcaccacacccgtaagcacctacatgctcacaaactcagaactcctatccctcatcaacgacatgcccatcaccaacgaccagaaaaagctaatgtccaacaacgtccaaatagtacgccaacaaagctactcgataatgtgcatcatcaaggaagaagtactcgcctacgtcgtccaactccccctctacggcgtaatcgacacaccctgctggaaactccacacgtccccactctgcacaacaaacacaaaagaaggatccaacatatgcctaacccgcaccgacaggggctggtactgcgacaacgcaggctcagtcagcttctttccccaagccgaaacatgcaaagtccaatccaaccgtgtcttctgcgacaccatgaactcgctcaccctaccctcggaagtcaatctctgcaacatcgacatcttcaacccaaaatacgactgtaaaatcatgaccagcaaaacagacgtttcttccagcgtcatcacatcactcggcgcgatcgtatcatgctatggcaaaacaaagtgcaccgctagcaataaaaaccgaggaatcataaaaaccttcagcaacggctgcgactacgtatccaacaaaggcgtcgacaccgtatccgtcggaaacaccctctactgcgtcaacaagcaagaaggacaatcactctacgtcaaaggcgaaccaatcataaacttctacgacccactcgtattcccctcagacgagttcgacgcatccatctcccaagtcaacgaaaagatcaaccaatctctcgcctttatacgcaaaagcgacgaactccttcacaacgtaaacgtcggcaaaagcaccactaacataatgatcaccacaatcataatagtaatcatcgtaatactcctcctactcatcgccgtgggcctattcctctattgcaaagcccgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14510 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut1 (opt1)
  source 1..1847: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14511 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut1 (opt1)
  source 1..1847: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14512 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut1 (opt2)
  source 1..1847: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14513 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut1 (opt3)
  source 1..1847: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14514 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut1 (opt4)
  source 1..1847: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14515 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut1 (opt5)
  source 1..1847: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14516 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut1 (opt6)
  source 1..1847: mol_type = other RNA
gggagagcggctcggccattttgtcccagtcagtccggaggctgcggctgcagaagtaccgcctgcggagtaactgcaaagaagcttaccatggaattaccaatactaaaaacaaacgcaataacaacaattctagcagcagtaacattatgctttgcatcatcccaaaacatcacagaagaattttatcaatcaacctgctcagcagtttccaaaggatacttaggagcattaagaactggttggtacacttcagtaatcaccatcgaactctcaaacatcaaggaaaacaaatgcaacggaacagacgcaaaagttaaactcataaaacaagaacttgacaaatacaaaaacgccgtaacagaactacaacttctcatgcaatcaacacccgcagcaggatccggatcagccatatgctcaggcatagcagtatgtaaagtattacatcttgaaggtgaagtaaacaaaataaaaaacgcacttctatcaaccaacaaagcagtagtatcactatcaaacggagtatccgtcttaacatttaaagttctagacctcaaaaactatatagacaaacaattactgccaatcctcaataaacaatcatgctcaataccaaacatcgaaacagtaatagaatttcaacaaaaaaacaacagactactagaaataacaagagaattttccgtcaacgccggcgtaactactccagtatcaacatatatgctaaccaactcagaactcctatccctcataaacgacatgccaataactaatgatcaaaaaaaactaatgtcaaacaatgtacaaatagttagacaacaatcatactcaatcatgtgcataataaaagaagaagtactagcatacgtcgtccaactacccctatacggagtaatagacacaccttgctggaaactacacacatcacccctatgcacaacaaatacaaaagaaggttccaacatctgcctaacaagaactgatagaggatggtactgcgacaacgccggatcagtatcattcttccctcaagctgaaacctgcaaagtacaatcaaacagagtattttgcgatacaatgaactccctaacacttccctcagaagttaatctttgtaatatagatatattcaacccaaaatacgactgcaaaataatgacaagtaaaacagacgtatcctcatctgtaattacatcactaggagccatagtatcttgctacggcaaaaccaaatgcacagcatcaaacaaaaacagaggtattatcaaaaccttctcaaacggatgtgactacgtttcaaacaaaggagtagacacagtatcagtcggaaacaccctatactgtgttaacaaacaagaaggacaatcactgtacgtaaaaggagaacccataataaatttctacgacccacttgtatttccatcagacgaatttgatgcatcaatctcacaagtaaatgaaaaaataaaccaatcattagcattcataagaaaatctgacgagttactacacaacgtaaatgttggcaaatcaacaaccaatataatgataacaacaataataatagtaataatagtcatattactcctcctcatagccgtcggattattcttatactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14517 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut1 (opt11)
  source 1..1847: mol_type = other RNA
gggagagcggctcggccattttgtcccagtcagtccggaggctgcggctgcagaagtaccgcctgcggagtaactgcaaagaagcttaccatggaactccccatactaaaaaccaacgccatcacaacaatcctcgccgccgtcacactctgcttcgccagctcccaaaacatcaccgaagagttctatcaatcaacctgctccgcagtctcaaagggatacctcggagccctccgcaccggatggtacacttccgtcatcacaatagaactctccaacatcaaagaaaacaaatgcaacggcaccgacgcaaaagtcaagctcatcaaacaagaactcgacaaatataaaaacgccgtcaccgaactccaactactcatgcaatccacacccgcggccggctcaggcagcgccatctgctcaggcatcgccgtctgcaaagtcctccacctcgaaggcgaagtcaacaaaatcaaaaacgcccttctttcaaccaacaaggcagtagtatccctctcaaacggcgtcagcgtcctgaccttcaaagtcctagacctcaaaaactacatagataaacaactcctccccatactgaacaaacaatcgtgctccatccccaatatcgaaaccgtcatagagttccagcagaaaaacaacagacttctcgaaataacccgagagttctcagtaaacgccggagtcaccacacccgtaagcacctacatgctcacaaactcagaactcctatccctcatcaacgacatgcccatcaccaacgaccagaaaaagctaatgtccaacaacgtccaaatagtacgccaacaaagctactcgataatgtgcatcatcaaggaagaagtactcgcctacgtcgtccaactccccctctacggcgtaatcgacacaccctgctggaaactccacacgtccccactctgcacaacaaacacaaaagaaggatccaacatatgcctaacccgcaccgacaggggctggtactgcgacaacgcaggctcagtcagcttctttccccaagccgaaacatgcaaagtccaatccaaccgtgtcttctgcgacaccatgaactcgctcaccctaccctcggaagtcaatctctgcaacatcgacatcttcaacccaaaatacgactgtaaaatcatgaccagcaaaacagacgtttcttccagcgtcatcacatcactcggcgcgatcgtatcatgctatggcaaaacaaagtgcaccgctagcaataaaaaccgaggaatcataaaaaccttcagcaacggctgcgactacgtatccaacaaaggcgtcgacaccgtatccgtcggaaacaccctctactgcgtcaacaagcaagaaggacaatcactctacgtcaaaggcgaaccaatcataaacttctacgacccactcgtattcccctcagacgagttcgacgcatccatctcccaagtcaacgaaaagatcaaccaatctctcgcctttatacgcaaaagcgacgaactccttcacaacgtaaacgtcggcaaaagcaccactaacataatgatcaccacaatcataatagtaatcatcgtaatactcctcctactcatcgccgtgggcctattcctctattgcaaagcccgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14518 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut1 (opt1)
  source 1..1914: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14519 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut1 (opt1)
  source 1..1914: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14520 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut1 (opt2)
  source 1..1914: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14521 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut1 (opt3)
  source 1..1914: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14522 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut1 (opt4)
  source 1..1914: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14523 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut1 (opt5)
  source 1..1914: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14524 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut1 (opt6)
  source 1..1914: mol_type = other RNA
gggagagcggctcggccattttgtcccagtcagtccggaggctgcggctgcagaagtaccgcctgcggagtaactgcaaagaagcttaccatggaattaccaatactaaaaacaaacgcaataacaacaattctagcagcagtaacattatgctttgcatcatcccaaaacatcacagaagaattttatcaatcaacctgctcagcagtttccaaaggatacttaggagcattaagaactggttggtacacttcagtaatcaccatcgaactctcaaacatcaaggaaaacaaatgcaacggaacagacgcaaaagttaaactcataaaacaagaacttgacaaatacaaaaacgccgtaacagaactacaacttctcatgcaatcaacacccgcagcaggatccggatcagccatatgctcaggcatagcagtatgtaaagtattacatcttgaaggtgaagtaaacaaaataaaaaacgcacttctatcaaccaacaaagcagtagtatcactatcaaacggagtatccgtcttaacatttaaagttctagacctcaaaaactatatagacaaacaattactgccaatcctcaataaacaatcatgctcaataccaaacatcgaaacagtaatagaatttcaacaaaaaaacaacagactactagaaataacaagagaattttccgtcaacgccggcgtaactactccagtatcaacatatatgctaaccaactcagaactcctatccctcataaacgacatgccaataactaatgatcaaaaaaaactaatgtcaaacaatgtacaaatagttagacaacaatcatactcaatcatgtgcataataaaagaagaagtactagcatacgtcgtccaactacccctatacggagtaatagacacaccttgctggaaactacacacatcacccctatgcacaacaaatacaaaagaaggttccaacatctgcctaacaagaactgatagaggatggtactgcgacaacgccggatcagtatcattcttccctcaagctgaaacctgcaaagtacaatcaaacagagtattttgcgatacaatgaactccctaacacttccctcagaagttaatctttgtaatatagatatattcaacccaaaatacgactgcaaaataatgacaagtaaaacagacgtatcctcatctgtaattacatcactaggagccatagtatcttgctacggcaaaaccaaatgcacagcatcaaacaaaaacagaggtattatcaaaaccttctcaaacggatgtgactacgtttcaaacaaaggagtagacacagtatcagtcggaaacaccctatactgtgttaacaaacaagaaggacaatcactgtacgtaaaaggagaacccataataaatttctacgacccacttgtatttccatcagacgaatttgatgcatcaatctcacaagtaaatgaaaaaataaaccaatcattagcattcataagaaaatctgacgagttactacacaacgtaaatgttggcaaatcaacaaccaatataatgataacaacaataataatagtaataatagtcatattactcctcctcatagccgtcggattattcttatactgcaaagcaagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14525 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut1 (opt11)
  source 1..1914: mol_type = other RNA
gggagagcggctcggccattttgtcccagtcagtccggaggctgcggctgcagaagtaccgcctgcggagtaactgcaaagaagcttaccatggaactccccatactaaaaaccaacgccatcacaacaatcctcgccgccgtcacactctgcttcgccagctcccaaaacatcaccgaagagttctatcaatcaacctgctccgcagtctcaaagggatacctcggagccctccgcaccggatggtacacttccgtcatcacaatagaactctccaacatcaaagaaaacaaatgcaacggcaccgacgcaaaagtcaagctcatcaaacaagaactcgacaaatataaaaacgccgtcaccgaactccaactactcatgcaatccacacccgcggccggctcaggcagcgccatctgctcaggcatcgccgtctgcaaagtcctccacctcgaaggcgaagtcaacaaaatcaaaaacgcccttctttcaaccaacaaggcagtagtatccctctcaaacggcgtcagcgtcctgaccttcaaagtcctagacctcaaaaactacatagataaacaactcctccccatactgaacaaacaatcgtgctccatccccaatatcgaaaccgtcatagagttccagcagaaaaacaacagacttctcgaaataacccgagagttctcagtaaacgccggagtcaccacacccgtaagcacctacatgctcacaaactcagaactcctatccctcatcaacgacatgcccatcaccaacgaccagaaaaagctaatgtccaacaacgtccaaatagtacgccaacaaagctactcgataatgtgcatcatcaaggaagaagtactcgcctacgtcgtccaactccccctctacggcgtaatcgacacaccctgctggaaactccacacgtccccactctgcacaacaaacacaaaagaaggatccaacatatgcctaacccgcaccgacaggggctggtactgcgacaacgcaggctcagtcagcttctttccccaagccgaaacatgcaaagtccaatccaaccgtgtcttctgcgacaccatgaactcgctcaccctaccctcggaagtcaatctctgcaacatcgacatcttcaacccaaaatacgactgtaaaatcatgaccagcaaaacagacgtttcttccagcgtcatcacatcactcggcgcgatcgtatcatgctatggcaaaacaaagtgcaccgctagcaataaaaaccgaggaatcataaaaaccttcagcaacggctgcgactacgtatccaacaaaggcgtcgacaccgtatccgtcggaaacaccctctactgcgtcaacaagcaagaaggacaatcactctacgtcaaaggcgaaccaatcataaacttctacgacccactcgtattcccctcagacgagttcgacgcatccatctcccaagtcaacgaaaagatcaaccaatctctcgcctttatacgcaaaagcgacgaactccttcacaacgtaaacgtcggcaaaagcaccactaacataatgatcaccacaatcataatagtaatcatcgtaatactcctcctactcatcgccgtgggcctattcctctattgcaaagcccgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14526 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut1 (opt1)
  source 1..2130: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14527 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut1 (opt1)
  source 1..2130: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14528 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut1 (opt2)
  source 1..2130: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14529 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut1 (opt3)
  source 1..2130: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14530 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut1 (opt4)
  source 1..2130: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14531 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut1 (opt5)
  source 1..2130: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14532 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut1 (opt6)
  source 1..2130: mol_type = other RNA
gggagagcggctcggccattttgtcccagtcagtccggaggctgcggctgcagaagtaccgcctgcggagtaactgcaaagaagcttaccatggaattaccaatactaaaaacaaacgcaataacaacaattctagcagcagtaacattatgctttgcatcatcccaaaacatcacagaagaattttatcaatcaacctgctcagcagtttccaaaggatacttaggagcattaagaactggttggtacacttcagtaatcaccatcgaactctcaaacatcaaggaaaacaaatgcaacggaacagacgcaaaagttaaactcataaaacaagaacttgacaaatacaaaaacgccgtaacagaactacaacttctcatgcaatcaacacccgcagcaggatccggatcagccatatgctcaggcatagcagtatgtaaagtattacatcttgaaggtgaagtaaacaaaataaaaaacgcacttctatcaaccaacaaagcagtagtatcactatcaaacggagtatccgtcttaacatttaaagttctagacctcaaaaactatatagacaaacaattactgccaatcctcaataaacaatcatgctcaataccaaacatcgaaacagtaatagaatttcaacaaaaaaacaacagactactagaaataacaagagaattttccgtcaacgccggcgtaactactccagtatcaacatatatgctaaccaactcagaactcctatccctcataaacgacatgccaataactaatgatcaaaaaaaactaatgtcaaacaatgtacaaatagttagacaacaatcatactcaatcatgtgcataataaaagaagaagtactagcatacgtcgtccaactacccctatacggagtaatagacacaccttgctggaaactacacacatcacccctatgcacaacaaatacaaaagaaggttccaacatctgcctaacaagaactgatagaggatggtactgcgacaacgccggatcagtatcattcttccctcaagctgaaacctgcaaagtacaatcaaacagagtattttgcgatacaatgaactccctaacacttccctcagaagttaatctttgtaatatagatatattcaacccaaaatacgactgcaaaataatgacaagtaaaacagacgtatcctcatctgtaattacatcactaggagccatagtatcttgctacggcaaaaccaaatgcacagcatcaaacaaaaacagaggtattatcaaaaccttctcaaacggatgtgactacgtttcaaacaaaggagtagacacagtatcagtcggaaacaccctatactgtgttaacaaacaagaaggacaatcactgtacgtaaaaggagaacccataataaatttctacgacccacttgtatttccatcagacgaatttgatgcatcaatctcacaagtaaatgaaaaaataaaccaatcattagcattcataagaaaatctgacgagttactacacaacgtaaatgttggcaaatcaacaaccaatataatgataacaacaataataatagtaataatagtcatattactcctcctcatagccgtcggattattcttatactgcaaagcaagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14533 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut1 (opt11)
  source 1..2130: mol_type = other RNA
gggagagcggctcggccattttgtcccagtcagtccggaggctgcggctgcagaagtaccgcctgcggagtaactgcaaagaagcttaccatggaactccccatactaaaaaccaacgccatcacaacaatcctcgccgccgtcacactctgcttcgccagctcccaaaacatcaccgaagagttctatcaatcaacctgctccgcagtctcaaagggatacctcggagccctccgcaccggatggtacacttccgtcatcacaatagaactctccaacatcaaagaaaacaaatgcaacggcaccgacgcaaaagtcaagctcatcaaacaagaactcgacaaatataaaaacgccgtcaccgaactccaactactcatgcaatccacacccgcggccggctcaggcagcgccatctgctcaggcatcgccgtctgcaaagtcctccacctcgaaggcgaagtcaacaaaatcaaaaacgcccttctttcaaccaacaaggcagtagtatccctctcaaacggcgtcagcgtcctgaccttcaaagtcctagacctcaaaaactacatagataaacaactcctccccatactgaacaaacaatcgtgctccatccccaatatcgaaaccgtcatagagttccagcagaaaaacaacagacttctcgaaataacccgagagttctcagtaaacgccggagtcaccacacccgtaagcacctacatgctcacaaactcagaactcctatccctcatcaacgacatgcccatcaccaacgaccagaaaaagctaatgtccaacaacgtccaaatagtacgccaacaaagctactcgataatgtgcatcatcaaggaagaagtactcgcctacgtcgtccaactccccctctacggcgtaatcgacacaccctgctggaaactccacacgtccccactctgcacaacaaacacaaaagaaggatccaacatatgcctaacccgcaccgacaggggctggtactgcgacaacgcaggctcagtcagcttctttccccaagccgaaacatgcaaagtccaatccaaccgtgtcttctgcgacaccatgaactcgctcaccctaccctcggaagtcaatctctgcaacatcgacatcttcaacccaaaatacgactgtaaaatcatgaccagcaaaacagacgtttcttccagcgtcatcacatcactcggcgcgatcgtatcatgctatggcaaaacaaagtgcaccgctagcaataaaaaccgaggaatcataaaaaccttcagcaacggctgcgactacgtatccaacaaaggcgtcgacaccgtatccgtcggaaacaccctctactgcgtcaacaagcaagaaggacaatcactctacgtcaaaggcgaaccaatcataaacttctacgacccactcgtattcccctcagacgagttcgacgcatccatctcccaagtcaacgaaaagatcaaccaatctctcgcctttatacgcaaaagcgacgaactccttcacaacgtaaacgtcggcaaaagcaccactaacataatgatcaccacaatcataatagtaatcatcgtaatactcctcctactcatcgccgtgggcctattcctctattgcaaagcccgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14534 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut1 (opt1)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14535 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut1 (opt1)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14536 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut1 (opt2)
  source 1..1910: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14537 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut1 (opt3)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14538 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut1 (opt4)
  source 1..1910: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14539 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut1 (opt5)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14540 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut1 (opt6)
  source 1..1910: mol_type = other RNA
gggagagcggctcggccattttgtcccagtcagtccggaggctgcggctgcagaagtaccgcctgcggagtaactgcaaagaagcttaccatggaattaccaatactaaaaacaaacgcaataacaacaattctagcagcagtaacattatgctttgcatcatcccaaaacatcacagaagaattttatcaatcaacctgctcagcagtttccaaaggatacttaggagcattaagaactggttggtacacttcagtaatcaccatcgaactctcaaacatcaaggaaaacaaatgcaacggaacagacgcaaaagttaaactcataaaacaagaacttgacaaatacaaaaacgccgtaacagaactacaacttctcatgcaatcaacacccgcagcaggatccggatcagccatatgctcaggcatagcagtatgtaaagtattacatcttgaaggtgaagtaaacaaaataaaaaacgcacttctatcaaccaacaaagcagtagtatcactatcaaacggagtatccgtcttaacatttaaagttctagacctcaaaaactatatagacaaacaattactgccaatcctcaataaacaatcatgctcaataccaaacatcgaaacagtaatagaatttcaacaaaaaaacaacagactactagaaataacaagagaattttccgtcaacgccggcgtaactactccagtatcaacatatatgctaaccaactcagaactcctatccctcataaacgacatgccaataactaatgatcaaaaaaaactaatgtcaaacaatgtacaaatagttagacaacaatcatactcaatcatgtgcataataaaagaagaagtactagcatacgtcgtccaactacccctatacggagtaatagacacaccttgctggaaactacacacatcacccctatgcacaacaaatacaaaagaaggttccaacatctgcctaacaagaactgatagaggatggtactgcgacaacgccggatcagtatcattcttccctcaagctgaaacctgcaaagtacaatcaaacagagtattttgcgatacaatgaactccctaacacttccctcagaagttaatctttgtaatatagatatattcaacccaaaatacgactgcaaaataatgacaagtaaaacagacgtatcctcatctgtaattacatcactaggagccatagtatcttgctacggcaaaaccaaatgcacagcatcaaacaaaaacagaggtattatcaaaaccttctcaaacggatgtgactacgtttcaaacaaaggagtagacacagtatcagtcggaaacaccctatactgtgttaacaaacaagaaggacaatcactgtacgtaaaaggagaacccataataaatttctacgacccacttgtatttccatcagacgaatttgatgcatcaatctcacaagtaaatgaaaaaataaaccaatcattagcattcataagaaaatctgacgagttactacacaacgtaaatgttggcaaatcaacaaccaatataatgataacaacaataataatagtaataatagtcatattactcctcctcatagccgtcggattattcttatactgcaaagcaagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14541 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut1 (opt11)
  source 1..1910: mol_type = other RNA
gggagagcggctcggccattttgtcccagtcagtccggaggctgcggctgcagaagtaccgcctgcggagtaactgcaaagaagcttaccatggaactccccatactaaaaaccaacgccatcacaacaatcctcgccgccgtcacactctgcttcgccagctcccaaaacatcaccgaagagttctatcaatcaacctgctccgcagtctcaaagggatacctcggagccctccgcaccggatggtacacttccgtcatcacaatagaactctccaacatcaaagaaaacaaatgcaacggcaccgacgcaaaagtcaagctcatcaaacaagaactcgacaaatataaaaacgccgtcaccgaactccaactactcatgcaatccacacccgcggccggctcaggcagcgccatctgctcaggcatcgccgtctgcaaagtcctccacctcgaaggcgaagtcaacaaaatcaaaaacgcccttctttcaaccaacaaggcagtagtatccctctcaaacggcgtcagcgtcctgaccttcaaagtcctagacctcaaaaactacatagataaacaactcctccccatactgaacaaacaatcgtgctccatccccaatatcgaaaccgtcatagagttccagcagaaaaacaacagacttctcgaaataacccgagagttctcagtaaacgccggagtcaccacacccgtaagcacctacatgctcacaaactcagaactcctatccctcatcaacgacatgcccatcaccaacgaccagaaaaagctaatgtccaacaacgtccaaatagtacgccaacaaagctactcgataatgtgcatcatcaaggaagaagtactcgcctacgtcgtccaactccccctctacggcgtaatcgacacaccctgctggaaactccacacgtccccactctgcacaacaaacacaaaagaaggatccaacatatgcctaacccgcaccgacaggggctggtactgcgacaacgcaggctcagtcagcttctttccccaagccgaaacatgcaaagtccaatccaaccgtgtcttctgcgacaccatgaactcgctcaccctaccctcggaagtcaatctctgcaacatcgacatcttcaacccaaaatacgactgtaaaatcatgaccagcaaaacagacgtttcttccagcgtcatcacatcactcggcgcgatcgtatcatgctatggcaaaacaaagtgcaccgctagcaataaaaaccgaggaatcataaaaaccttcagcaacggctgcgactacgtatccaacaaaggcgtcgacaccgtatccgtcggaaacaccctctactgcgtcaacaagcaagaaggacaatcactctacgtcaaaggcgaaccaatcataaacttctacgacccactcgtattcccctcagacgagttcgacgcatccatctcccaagtcaacgaaaagatcaaccaatctctcgcctttatacgcaaaagcgacgaactccttcacaacgtaaacgtcggcaaaagcaccactaacataatgatcaccacaatcataatagtaatcatcgtaatactcctcctactcatcgccgtgggcctattcctctattgcaaagcccgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14542 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut1 (opt1)
  source 1..1901: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14543 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut1 (opt1)
  source 1..1901: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14544 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut1 (opt2)
  source 1..1901: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14545 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut1 (opt3)
  source 1..1901: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14546 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut1 (opt4)
  source 1..1901: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14547 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut1 (opt5)
  source 1..1901: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14548 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut1 (opt6)
  source 1..1901: mol_type = other RNA
gggagagtcccgcagtcggcgtccagcggctctgcttgttcgtgtgtgtgtcgttgcaggccttattcaagcttaccatggaattaccaatactaaaaacaaacgcaataacaacaattctagcagcagtaacattatgctttgcatcatcccaaaacatcacagaagaattttatcaatcaacctgctcagcagtttccaaaggatacttaggagcattaagaactggttggtacacttcagtaatcaccatcgaactctcaaacatcaaggaaaacaaatgcaacggaacagacgcaaaagttaaactcataaaacaagaacttgacaaatacaaaaacgccgtaacagaactacaacttctcatgcaatcaacacccgcagcaggatccggatcagccatatgctcaggcatagcagtatgtaaagtattacatcttgaaggtgaagtaaacaaaataaaaaacgcacttctatcaaccaacaaagcagtagtatcactatcaaacggagtatccgtcttaacatttaaagttctagacctcaaaaactatatagacaaacaattactgccaatcctcaataaacaatcatgctcaataccaaacatcgaaacagtaatagaatttcaacaaaaaaacaacagactactagaaataacaagagaattttccgtcaacgccggcgtaactactccagtatcaacatatatgctaaccaactcagaactcctatccctcataaacgacatgccaataactaatgatcaaaaaaaactaatgtcaaacaatgtacaaatagttagacaacaatcatactcaatcatgtgcataataaaagaagaagtactagcatacgtcgtccaactacccctatacggagtaatagacacaccttgctggaaactacacacatcacccctatgcacaacaaatacaaaagaaggttccaacatctgcctaacaagaactgatagaggatggtactgcgacaacgccggatcagtatcattcttccctcaagctgaaacctgcaaagtacaatcaaacagagtattttgcgatacaatgaactccctaacacttccctcagaagttaatctttgtaatatagatatattcaacccaaaatacgactgcaaaataatgacaagtaaaacagacgtatcctcatctgtaattacatcactaggagccatagtatcttgctacggcaaaaccaaatgcacagcatcaaacaaaaacagaggtattatcaaaaccttctcaaacggatgtgactacgtttcaaacaaaggagtagacacagtatcagtcggaaacaccctatactgtgttaacaaacaagaaggacaatcactgtacgtaaaaggagaacccataataaatttctacgacccacttgtatttccatcagacgaatttgatgcatcaatctcacaagtaaatgaaaaaataaaccaatcattagcattcataagaaaatctgacgagttactacacaacgtaaatgttggcaaatcaacaaccaatataatgataacaacaataataatagtaataatagtcatattactcctcctcatagccgtcggattattcttatactgcaaagcaagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14549 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut1 (opt11)
  source 1..1901: mol_type = other RNA
gggagagtcccgcagtcggcgtccagcggctctgcttgttcgtgtgtgtgtcgttgcaggccttattcaagcttaccatggaactccccatactaaaaaccaacgccatcacaacaatcctcgccgccgtcacactctgcttcgccagctcccaaaacatcaccgaagagttctatcaatcaacctgctccgcagtctcaaagggatacctcggagccctccgcaccggatggtacacttccgtcatcacaatagaactctccaacatcaaagaaaacaaatgcaacggcaccgacgcaaaagtcaagctcatcaaacaagaactcgacaaatataaaaacgccgtcaccgaactccaactactcatgcaatccacacccgcggccggctcaggcagcgccatctgctcaggcatcgccgtctgcaaagtcctccacctcgaaggcgaagtcaacaaaatcaaaaacgcccttctttcaaccaacaaggcagtagtatccctctcaaacggcgtcagcgtcctgaccttcaaagtcctagacctcaaaaactacatagataaacaactcctccccatactgaacaaacaatcgtgctccatccccaatatcgaaaccgtcatagagttccagcagaaaaacaacagacttctcgaaataacccgagagttctcagtaaacgccggagtcaccacacccgtaagcacctacatgctcacaaactcagaactcctatccctcatcaacgacatgcccatcaccaacgaccagaaaaagctaatgtccaacaacgtccaaatagtacgccaacaaagctactcgataatgtgcatcatcaaggaagaagtactcgcctacgtcgtccaactccccctctacggcgtaatcgacacaccctgctggaaactccacacgtccccactctgcacaacaaacacaaaagaaggatccaacatatgcctaacccgcaccgacaggggctggtactgcgacaacgcaggctcagtcagcttctttccccaagccgaaacatgcaaagtccaatccaaccgtgtcttctgcgacaccatgaactcgctcaccctaccctcggaagtcaatctctgcaacatcgacatcttcaacccaaaatacgactgtaaaatcatgaccagcaaaacagacgtttcttccagcgtcatcacatcactcggcgcgatcgtatcatgctatggcaaaacaaagtgcaccgctagcaataaaaaccgaggaatcataaaaaccttcagcaacggctgcgactacgtatccaacaaaggcgtcgacaccgtatccgtcggaaacaccctctactgcgtcaacaagcaagaaggacaatcactctacgtcaaaggcgaaccaatcataaacttctacgacccactcgtattcccctcagacgagttcgacgcatccatctcccaagtcaacgaaaagatcaaccaatctctcgcctttatacgcaaaagcgacgaactccttcacaacgtaaacgtcggcaaaagcaccactaacataatgatcaccacaatcataatagtaatcatcgtaatactcctcctactcatcgccgtgggcctattcctctattgcaaagcccgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14550 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut1 (opt1)
  source 1..2117: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14551 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut1 (opt1)
  source 1..2117: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14552 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut1 (opt2)
  source 1..2117: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14553 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut1 (opt3)
  source 1..2117: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14554 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut1 (opt4)
  source 1..2117: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14555 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut1 (opt5)
  source 1..2117: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14556 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut1 (opt6)
  source 1..2117: mol_type = other RNA
gggagagtcccgcagtcggcgtccagcggctctgcttgttcgtgtgtgtgtcgttgcaggccttattcaagcttaccatggaattaccaatactaaaaacaaacgcaataacaacaattctagcagcagtaacattatgctttgcatcatcccaaaacatcacagaagaattttatcaatcaacctgctcagcagtttccaaaggatacttaggagcattaagaactggttggtacacttcagtaatcaccatcgaactctcaaacatcaaggaaaacaaatgcaacggaacagacgcaaaagttaaactcataaaacaagaacttgacaaatacaaaaacgccgtaacagaactacaacttctcatgcaatcaacacccgcagcaggatccggatcagccatatgctcaggcatagcagtatgtaaagtattacatcttgaaggtgaagtaaacaaaataaaaaacgcacttctatcaaccaacaaagcagtagtatcactatcaaacggagtatccgtcttaacatttaaagttctagacctcaaaaactatatagacaaacaattactgccaatcctcaataaacaatcatgctcaataccaaacatcgaaacagtaatagaatttcaacaaaaaaacaacagactactagaaataacaagagaattttccgtcaacgccggcgtaactactccagtatcaacatatatgctaaccaactcagaactcctatccctcataaacgacatgccaataactaatgatcaaaaaaaactaatgtcaaacaatgtacaaatagttagacaacaatcatactcaatcatgtgcataataaaagaagaagtactagcatacgtcgtccaactacccctatacggagtaatagacacaccttgctggaaactacacacatcacccctatgcacaacaaatacaaaagaaggttccaacatctgcctaacaagaactgatagaggatggtactgcgacaacgccggatcagtatcattcttccctcaagctgaaacctgcaaagtacaatcaaacagagtattttgcgatacaatgaactccctaacacttccctcagaagttaatctttgtaatatagatatattcaacccaaaatacgactgcaaaataatgacaagtaaaacagacgtatcctcatctgtaattacatcactaggagccatagtatcttgctacggcaaaaccaaatgcacagcatcaaacaaaaacagaggtattatcaaaaccttctcaaacggatgtgactacgtttcaaacaaaggagtagacacagtatcagtcggaaacaccctatactgtgttaacaaacaagaaggacaatcactgtacgtaaaaggagaacccataataaatttctacgacccacttgtatttccatcagacgaatttgatgcatcaatctcacaagtaaatgaaaaaataaaccaatcattagcattcataagaaaatctgacgagttactacacaacgtaaatgttggcaaatcaacaaccaatataatgataacaacaataataatagtaataatagtcatattactcctcctcatagccgtcggattattcttatactgcaaagcaagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14557 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut1 (opt11)
  source 1..2117: mol_type = other RNA
gggagagtcccgcagtcggcgtccagcggctctgcttgttcgtgtgtgtgtcgttgcaggccttattcaagcttaccatggaactccccatactaaaaaccaacgccatcacaacaatcctcgccgccgtcacactctgcttcgccagctcccaaaacatcaccgaagagttctatcaatcaacctgctccgcagtctcaaagggatacctcggagccctccgcaccggatggtacacttccgtcatcacaatagaactctccaacatcaaagaaaacaaatgcaacggcaccgacgcaaaagtcaagctcatcaaacaagaactcgacaaatataaaaacgccgtcaccgaactccaactactcatgcaatccacacccgcggccggctcaggcagcgccatctgctcaggcatcgccgtctgcaaagtcctccacctcgaaggcgaagtcaacaaaatcaaaaacgcccttctttcaaccaacaaggcagtagtatccctctcaaacggcgtcagcgtcctgaccttcaaagtcctagacctcaaaaactacatagataaacaactcctccccatactgaacaaacaatcgtgctccatccccaatatcgaaaccgtcatagagttccagcagaaaaacaacagacttctcgaaataacccgagagttctcagtaaacgccggagtcaccacacccgtaagcacctacatgctcacaaactcagaactcctatccctcatcaacgacatgcccatcaccaacgaccagaaaaagctaatgtccaacaacgtccaaatagtacgccaacaaagctactcgataatgtgcatcatcaaggaagaagtactcgcctacgtcgtccaactccccctctacggcgtaatcgacacaccctgctggaaactccacacgtccccactctgcacaacaaacacaaaagaaggatccaacatatgcctaacccgcaccgacaggggctggtactgcgacaacgcaggctcagtcagcttctttccccaagccgaaacatgcaaagtccaatccaaccgtgtcttctgcgacaccatgaactcgctcaccctaccctcggaagtcaatctctgcaacatcgacatcttcaacccaaaatacgactgtaaaatcatgaccagcaaaacagacgtttcttccagcgtcatcacatcactcggcgcgatcgtatcatgctatggcaaaacaaagtgcaccgctagcaataaaaaccgaggaatcataaaaaccttcagcaacggctgcgactacgtatccaacaaaggcgtcgacaccgtatccgtcggaaacaccctctactgcgtcaacaagcaagaaggacaatcactctacgtcaaaggcgaaccaatcataaacttctacgacccactcgtattcccctcagacgagttcgacgcatccatctcccaagtcaacgaaaagatcaaccaatctctcgcctttatacgcaaaagcgacgaactccttcacaacgtaaacgtcggcaaaagcaccactaacataatgatcaccacaatcataatagtaatcatcgtaatactcctcctactcatcgccgtgggcctattcctctattgcaaagcccgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14558 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut1 (opt1)
  source 1..1893: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14559 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut1 (opt1)
  source 1..1893: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14560 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut1 (opt2)
  source 1..1893: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14561 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut1 (opt3)
  source 1..1893: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14562 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut1 (opt4)
  source 1..1893: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14563 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut1 (opt5)
  source 1..1893: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14564 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut1 (opt6)
  source 1..1893: mol_type = other RNA
gggagactttcccattctgtagcagaatttggtgttgcctgtggtcttggtcccgcggagaagcttaccatggaattaccaatactaaaaacaaacgcaataacaacaattctagcagcagtaacattatgctttgcatcatcccaaaacatcacagaagaattttatcaatcaacctgctcagcagtttccaaaggatacttaggagcattaagaactggttggtacacttcagtaatcaccatcgaactctcaaacatcaaggaaaacaaatgcaacggaacagacgcaaaagttaaactcataaaacaagaacttgacaaatacaaaaacgccgtaacagaactacaacttctcatgcaatcaacacccgcagcaggatccggatcagccatatgctcaggcatagcagtatgtaaagtattacatcttgaaggtgaagtaaacaaaataaaaaacgcacttctatcaaccaacaaagcagtagtatcactatcaaacggagtatccgtcttaacatttaaagttctagacctcaaaaactatatagacaaacaattactgccaatcctcaataaacaatcatgctcaataccaaacatcgaaacagtaatagaatttcaacaaaaaaacaacagactactagaaataacaagagaattttccgtcaacgccggcgtaactactccagtatcaacatatatgctaaccaactcagaactcctatccctcataaacgacatgccaataactaatgatcaaaaaaaactaatgtcaaacaatgtacaaatagttagacaacaatcatactcaatcatgtgcataataaaagaagaagtactagcatacgtcgtccaactacccctatacggagtaatagacacaccttgctggaaactacacacatcacccctatgcacaacaaatacaaaagaaggttccaacatctgcctaacaagaactgatagaggatggtactgcgacaacgccggatcagtatcattcttccctcaagctgaaacctgcaaagtacaatcaaacagagtattttgcgatacaatgaactccctaacacttccctcagaagttaatctttgtaatatagatatattcaacccaaaatacgactgcaaaataatgacaagtaaaacagacgtatcctcatctgtaattacatcactaggagccatagtatcttgctacggcaaaaccaaatgcacagcatcaaacaaaaacagaggtattatcaaaaccttctcaaacggatgtgactacgtttcaaacaaaggagtagacacagtatcagtcggaaacaccctatactgtgttaacaaacaagaaggacaatcactgtacgtaaaaggagaacccataataaatttctacgacccacttgtatttccatcagacgaatttgatgcatcaatctcacaagtaaatgaaaaaataaaccaatcattagcattcataagaaaatctgacgagttactacacaacgtaaatgttggcaaatcaacaaccaatataatgataacaacaataataatagtaataatagtcatattactcctcctcatagccgtcggattattcttatactgcaaagcaagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14565 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut1 (opt11)
  source 1..1893: mol_type = other RNA
gggagactttcccattctgtagcagaatttggtgttgcctgtggtcttggtcccgcggagaagcttaccatggaactccccatactaaaaaccaacgccatcacaacaatcctcgccgccgtcacactctgcttcgccagctcccaaaacatcaccgaagagttctatcaatcaacctgctccgcagtctcaaagggatacctcggagccctccgcaccggatggtacacttccgtcatcacaatagaactctccaacatcaaagaaaacaaatgcaacggcaccgacgcaaaagtcaagctcatcaaacaagaactcgacaaatataaaaacgccgtcaccgaactccaactactcatgcaatccacacccgcggccggctcaggcagcgccatctgctcaggcatcgccgtctgcaaagtcctccacctcgaaggcgaagtcaacaaaatcaaaaacgcccttctttcaaccaacaaggcagtagtatccctctcaaacggcgtcagcgtcctgaccttcaaagtcctagacctcaaaaactacatagataaacaactcctccccatactgaacaaacaatcgtgctccatccccaatatcgaaaccgtcatagagttccagcagaaaaacaacagacttctcgaaataacccgagagttctcagtaaacgccggagtcaccacacccgtaagcacctacatgctcacaaactcagaactcctatccctcatcaacgacatgcccatcaccaacgaccagaaaaagctaatgtccaacaacgtccaaatagtacgccaacaaagctactcgataatgtgcatcatcaaggaagaagtactcgcctacgtcgtccaactccccctctacggcgtaatcgacacaccctgctggaaactccacacgtccccactctgcacaacaaacacaaaagaaggatccaacatatgcctaacccgcaccgacaggggctggtactgcgacaacgcaggctcagtcagcttctttccccaagccgaaacatgcaaagtccaatccaaccgtgtcttctgcgacaccatgaactcgctcaccctaccctcggaagtcaatctctgcaacatcgacatcttcaacccaaaatacgactgtaaaatcatgaccagcaaaacagacgtttcttccagcgtcatcacatcactcggcgcgatcgtatcatgctatggcaaaacaaagtgcaccgctagcaataaaaaccgaggaatcataaaaaccttcagcaacggctgcgactacgtatccaacaaaggcgtcgacaccgtatccgtcggaaacaccctctactgcgtcaacaagcaagaaggacaatcactctacgtcaaaggcgaaccaatcataaacttctacgacccactcgtattcccctcagacgagttcgacgcatccatctcccaagtcaacgaaaagatcaaccaatctctcgcctttatacgcaaaagcgacgaactccttcacaacgtaaacgtcggcaaaagcaccactaacataatgatcaccacaatcataatagtaatcatcgtaatactcctcctactcatcgccgtgggcctattcctctattgcaaagcccgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14566 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut1 (opt1)
  source 1..1889: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14567 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut1 (opt1)
  source 1..1889: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14568 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut1 (opt2)
  source 1..1889: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14569 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut1 (opt3)
  source 1..1889: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14570 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut1 (opt4)
  source 1..1889: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14571 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut1 (opt5)
  source 1..1889: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14572 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut1 (opt6)
  source 1..1889: mol_type = other RNA
gggagactttcccattctgtagcagaatttggtgttgcctgtggtcttggtcccgcggagaagcttaccatggaattaccaatactaaaaacaaacgcaataacaacaattctagcagcagtaacattatgctttgcatcatcccaaaacatcacagaagaattttatcaatcaacctgctcagcagtttccaaaggatacttaggagcattaagaactggttggtacacttcagtaatcaccatcgaactctcaaacatcaaggaaaacaaatgcaacggaacagacgcaaaagttaaactcataaaacaagaacttgacaaatacaaaaacgccgtaacagaactacaacttctcatgcaatcaacacccgcagcaggatccggatcagccatatgctcaggcatagcagtatgtaaagtattacatcttgaaggtgaagtaaacaaaataaaaaacgcacttctatcaaccaacaaagcagtagtatcactatcaaacggagtatccgtcttaacatttaaagttctagacctcaaaaactatatagacaaacaattactgccaatcctcaataaacaatcatgctcaataccaaacatcgaaacagtaatagaatttcaacaaaaaaacaacagactactagaaataacaagagaattttccgtcaacgccggcgtaactactccagtatcaacatatatgctaaccaactcagaactcctatccctcataaacgacatgccaataactaatgatcaaaaaaaactaatgtcaaacaatgtacaaatagttagacaacaatcatactcaatcatgtgcataataaaagaagaagtactagcatacgtcgtccaactacccctatacggagtaatagacacaccttgctggaaactacacacatcacccctatgcacaacaaatacaaaagaaggttccaacatctgcctaacaagaactgatagaggatggtactgcgacaacgccggatcagtatcattcttccctcaagctgaaacctgcaaagtacaatcaaacagagtattttgcgatacaatgaactccctaacacttccctcagaagttaatctttgtaatatagatatattcaacccaaaatacgactgcaaaataatgacaagtaaaacagacgtatcctcatctgtaattacatcactaggagccatagtatcttgctacggcaaaaccaaatgcacagcatcaaacaaaaacagaggtattatcaaaaccttctcaaacggatgtgactacgtttcaaacaaaggagtagacacagtatcagtcggaaacaccctatactgtgttaacaaacaagaaggacaatcactgtacgtaaaaggagaacccataataaatttctacgacccacttgtatttccatcagacgaatttgatgcatcaatctcacaagtaaatgaaaaaataaaccaatcattagcattcataagaaaatctgacgagttactacacaacgtaaatgttggcaaatcaacaaccaatataatgataacaacaataataatagtaataatagtcatattactcctcctcatagccgtcggattattcttatactgcaaagcaagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14573 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut1 (opt11)
  source 1..1889: mol_type = other RNA
gggagactttcccattctgtagcagaatttggtgttgcctgtggtcttggtcccgcggagaagcttaccatggaactccccatactaaaaaccaacgccatcacaacaatcctcgccgccgtcacactctgcttcgccagctcccaaaacatcaccgaagagttctatcaatcaacctgctccgcagtctcaaagggatacctcggagccctccgcaccggatggtacacttccgtcatcacaatagaactctccaacatcaaagaaaacaaatgcaacggcaccgacgcaaaagtcaagctcatcaaacaagaactcgacaaatataaaaacgccgtcaccgaactccaactactcatgcaatccacacccgcggccggctcaggcagcgccatctgctcaggcatcgccgtctgcaaagtcctccacctcgaaggcgaagtcaacaaaatcaaaaacgcccttctttcaaccaacaaggcagtagtatccctctcaaacggcgtcagcgtcctgaccttcaaagtcctagacctcaaaaactacatagataaacaactcctccccatactgaacaaacaatcgtgctccatccccaatatcgaaaccgtcatagagttccagcagaaaaacaacagacttctcgaaataacccgagagttctcagtaaacgccggagtcaccacacccgtaagcacctacatgctcacaaactcagaactcctatccctcatcaacgacatgcccatcaccaacgaccagaaaaagctaatgtccaacaacgtccaaatagtacgccaacaaagctactcgataatgtgcatcatcaaggaagaagtactcgcctacgtcgtccaactccccctctacggcgtaatcgacacaccctgctggaaactccacacgtccccactctgcacaacaaacacaaaagaaggatccaacatatgcctaacccgcaccgacaggggctggtactgcgacaacgcaggctcagtcagcttctttccccaagccgaaacatgcaaagtccaatccaaccgtgtcttctgcgacaccatgaactcgctcaccctaccctcggaagtcaatctctgcaacatcgacatcttcaacccaaaatacgactgtaaaatcatgaccagcaaaacagacgtttcttccagcgtcatcacatcactcggcgcgatcgtatcatgctatggcaaaacaaagtgcaccgctagcaataaaaaccgaggaatcataaaaaccttcagcaacggctgcgactacgtatccaacaaaggcgtcgacaccgtatccgtcggaaacaccctctactgcgtcaacaagcaagaaggacaatcactctacgtcaaaggcgaaccaatcataaacttctacgacccactcgtattcccctcagacgagttcgacgcatccatctcccaagtcaacgaaaagatcaaccaatctctcgcctttatacgcaaaagcgacgaactccttcacaacgtaaacgtcggcaaaagcaccactaacataatgatcaccacaatcataatagtaatcatcgtaatactcctcctactcatcgccgtgggcctattcctctattgcaaagcccgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14574 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut1 (opt1)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14575 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut1 (opt1)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14576 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut1 (opt2)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14577 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut1 (opt3)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14578 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut1 (opt4)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14579 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut1 (opt5)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14580 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut1 (opt6)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggaattaccaatactaaaaacaaacgcaataacaacaattctagcagcagtaacattatgctttgcatcatcccaaaacatcacagaagaattttatcaatcaacctgctcagcagtttccaaaggatacttaggagcattaagaactggttggtacacttcagtaatcaccatcgaactctcaaacatcaaggaaaacaaatgcaacggaacagacgcaaaagttaaactcataaaacaagaacttgacaaatacaaaaacgccgtaacagaactacaacttctcatgcaatcaacacccgcagcaggatccggatcagccatatgctcaggcatagcagtatgtaaagtattacatcttgaaggtgaagtaaacaaaataaaaaacgcacttctatcaaccaacaaagcagtagtatcactatcaaacggagtatccgtcttaacatttaaagttctagacctcaaaaactatatagacaaacaattactgccaatcctcaataaacaatcatgctcaataccaaacatcgaaacagtaatagaatttcaacaaaaaaacaacagactactagaaataacaagagaattttccgtcaacgccggcgtaactactccagtatcaacatatatgctaaccaactcagaactcctatccctcataaacgacatgccaataactaatgatcaaaaaaaactaatgtcaaacaatgtacaaatagttagacaacaatcatactcaatcatgtgcataataaaagaagaagtactagcatacgtcgtccaactacccctatacggagtaatagacacaccttgctggaaactacacacatcacccctatgcacaacaaatacaaaagaaggttccaacatctgcctaacaagaactgatagaggatggtactgcgacaacgccggatcagtatcattcttccctcaagctgaaacctgcaaagtacaatcaaacagagtattttgcgatacaatgaactccctaacacttccctcagaagttaatctttgtaatatagatatattcaacccaaaatacgactgcaaaataatgacaagtaaaacagacgtatcctcatctgtaattacatcactaggagccatagtatcttgctacggcaaaaccaaatgcacagcatcaaacaaaaacagaggtattatcaaaaccttctcaaacggatgtgactacgtttcaaacaaaggagtagacacagtatcagtcggaaacaccctatactgtgttaacaaacaagaaggacaatcactgtacgtaaaaggagaacccataataaatttctacgacccacttgtatttccatcagacgaatttgatgcatcaatctcacaagtaaatgaaaaaataaaccaatcattagcattcataagaaaatctgacgagttactacacaacgtaaatgttggcaaatcaacaaccaatataatgataacaacaataataatagtaataatagtcatattactcctcctcatagccgtcggattattcttatactgcaaagcaagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14581 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut1 (opt11)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggaactccccatactaaaaaccaacgccatcacaacaatcctcgccgccgtcacactctgcttcgccagctcccaaaacatcaccgaagagttctatcaatcaacctgctccgcagtctcaaagggatacctcggagccctccgcaccggatggtacacttccgtcatcacaatagaactctccaacatcaaagaaaacaaatgcaacggcaccgacgcaaaagtcaagctcatcaaacaagaactcgacaaatataaaaacgccgtcaccgaactccaactactcatgcaatccacacccgcggccggctcaggcagcgccatctgctcaggcatcgccgtctgcaaagtcctccacctcgaaggcgaagtcaacaaaatcaaaaacgcccttctttcaaccaacaaggcagtagtatccctctcaaacggcgtcagcgtcctgaccttcaaagtcctagacctcaaaaactacatagataaacaactcctccccatactgaacaaacaatcgtgctccatccccaatatcgaaaccgtcatagagttccagcagaaaaacaacagacttctcgaaataacccgagagttctcagtaaacgccggagtcaccacacccgtaagcacctacatgctcacaaactcagaactcctatccctcatcaacgacatgcccatcaccaacgaccagaaaaagctaatgtccaacaacgtccaaatagtacgccaacaaagctactcgataatgtgcatcatcaaggaagaagtactcgcctacgtcgtccaactccccctctacggcgtaatcgacacaccctgctggaaactccacacgtccccactctgcacaacaaacacaaaagaaggatccaacatatgcctaacccgcaccgacaggggctggtactgcgacaacgcaggctcagtcagcttctttccccaagccgaaacatgcaaagtccaatccaaccgtgtcttctgcgacaccatgaactcgctcaccctaccctcggaagtcaatctctgcaacatcgacatcttcaacccaaaatacgactgtaaaatcatgaccagcaaaacagacgtttcttccagcgtcatcacatcactcggcgcgatcgtatcatgctatggcaaaacaaagtgcaccgctagcaataaaaaccgaggaatcataaaaaccttcagcaacggctgcgactacgtatccaacaaaggcgtcgacaccgtatccgtcggaaacaccctctactgcgtcaacaagcaagaaggacaatcactctacgtcaaaggcgaaccaatcataaacttctacgacccactcgtattcccctcagacgagttcgacgcatccatctcccaagtcaacgaaaagatcaaccaatctctcgcctttatacgcaaaagcgacgaactccttcacaacgtaaacgtcggcaaaagcaccactaacataatgatcaccacaatcataatagtaatcatcgtaatactcctcctactcatcgccgtgggcctattcctctattgcaaagcccgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14582 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut1 (opt1)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14583 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut1 (opt1)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14584 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut1 (opt2)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14585 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut1 (opt3)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14586 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut1 (opt4)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14587 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut1 (opt5)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14588 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut1 (opt6)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggaattaccaatactaaaaacaaacgcaataacaacaattctagcagcagtaacattatgctttgcatcatcccaaaacatcacagaagaattttatcaatcaacctgctcagcagtttccaaaggatacttaggagcattaagaactggttggtacacttcagtaatcaccatcgaactctcaaacatcaaggaaaacaaatgcaacggaacagacgcaaaagttaaactcataaaacaagaacttgacaaatacaaaaacgccgtaacagaactacaacttctcatgcaatcaacacccgcagcaggatccggatcagccatatgctcaggcatagcagtatgtaaagtattacatcttgaaggtgaagtaaacaaaataaaaaacgcacttctatcaaccaacaaagcagtagtatcactatcaaacggagtatccgtcttaacatttaaagttctagacctcaaaaactatatagacaaacaattactgccaatcctcaataaacaatcatgctcaataccaaacatcgaaacagtaatagaatttcaacaaaaaaacaacagactactagaaataacaagagaattttccgtcaacgccggcgtaactactccagtatcaacatatatgctaaccaactcagaactcctatccctcataaacgacatgccaataactaatgatcaaaaaaaactaatgtcaaacaatgtacaaatagttagacaacaatcatactcaatcatgtgcataataaaagaagaagtactagcatacgtcgtccaactacccctatacggagtaatagacacaccttgctggaaactacacacatcacccctatgcacaacaaatacaaaagaaggttccaacatctgcctaacaagaactgatagaggatggtactgcgacaacgccggatcagtatcattcttccctcaagctgaaacctgcaaagtacaatcaaacagagtattttgcgatacaatgaactccctaacacttccctcagaagttaatctttgtaatatagatatattcaacccaaaatacgactgcaaaataatgacaagtaaaacagacgtatcctcatctgtaattacatcactaggagccatagtatcttgctacggcaaaaccaaatgcacagcatcaaacaaaaacagaggtattatcaaaaccttctcaaacggatgtgactacgtttcaaacaaaggagtagacacagtatcagtcggaaacaccctatactgtgttaacaaacaagaaggacaatcactgtacgtaaaaggagaacccataataaatttctacgacccacttgtatttccatcagacgaatttgatgcatcaatctcacaagtaaatgaaaaaataaaccaatcattagcattcataagaaaatctgacgagttactacacaacgtaaatgttggcaaatcaacaaccaatataatgataacaacaataataatagtaataatagtcatattactcctcctcatagccgtcggattattcttatactgcaaagcaagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14589 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut1 (opt11)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggaactccccatactaaaaaccaacgccatcacaacaatcctcgccgccgtcacactctgcttcgccagctcccaaaacatcaccgaagagttctatcaatcaacctgctccgcagtctcaaagggatacctcggagccctccgcaccggatggtacacttccgtcatcacaatagaactctccaacatcaaagaaaacaaatgcaacggcaccgacgcaaaagtcaagctcatcaaacaagaactcgacaaatataaaaacgccgtcaccgaactccaactactcatgcaatccacacccgcggccggctcaggcagcgccatctgctcaggcatcgccgtctgcaaagtcctccacctcgaaggcgaagtcaacaaaatcaaaaacgcccttctttcaaccaacaaggcagtagtatccctctcaaacggcgtcagcgtcctgaccttcaaagtcctagacctcaaaaactacatagataaacaactcctccccatactgaacaaacaatcgtgctccatccccaatatcgaaaccgtcatagagttccagcagaaaaacaacagacttctcgaaataacccgagagttctcagtaaacgccggagtcaccacacccgtaagcacctacatgctcacaaactcagaactcctatccctcatcaacgacatgcccatcaccaacgaccagaaaaagctaatgtccaacaacgtccaaatagtacgccaacaaagctactcgataatgtgcatcatcaaggaagaagtactcgcctacgtcgtccaactccccctctacggcgtaatcgacacaccctgctggaaactccacacgtccccactctgcacaacaaacacaaaagaaggatccaacatatgcctaacccgcaccgacaggggctggtactgcgacaacgcaggctcagtcagcttctttccccaagccgaaacatgcaaagtccaatccaaccgtgtcttctgcgacaccatgaactcgctcaccctaccctcggaagtcaatctctgcaacatcgacatcttcaacccaaaatacgactgtaaaatcatgaccagcaaaacagacgtttcttccagcgtcatcacatcactcggcgcgatcgtatcatgctatggcaaaacaaagtgcaccgctagcaataaaaaccgaggaatcataaaaaccttcagcaacggctgcgactacgtatccaacaaaggcgtcgacaccgtatccgtcggaaacaccctctactgcgtcaacaagcaagaaggacaatcactctacgtcaaaggcgaaccaatcataaacttctacgacccactcgtattcccctcagacgagttcgacgcatccatctcccaagtcaacgaaaagatcaaccaatctctcgcctttatacgcaaaagcgacgaactccttcacaacgtaaacgtcggcaaaagcaccactaacataatgatcaccacaatcataatagtaatcatcgtaatactcctcctactcatcgccgtgggcctattcctctattgcaaagcccgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14590 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut1 (opt1)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14591 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut1 (opt1)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14592 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut1 (opt2)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14593 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut1 (opt3)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14594 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut1 (opt4)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14595 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut1 (opt5)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14596 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut1 (opt6)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattaccaatactaaaaacaaacgcaataacaacaattctagcagcagtaacattatgctttgcatcatcccaaaacatcacagaagaattttatcaatcaacctgctcagcagtttccaaaggatacttaggagcattaagaactggttggtacacttcagtaatcaccatcgaactctcaaacatcaaggaaaacaaatgcaacggaacagacgcaaaagttaaactcataaaacaagaacttgacaaatacaaaaacgccgtaacagaactacaacttctcatgcaatcaacacccgcagcaggatccggatcagccatatgctcaggcatagcagtatgtaaagtattacatcttgaaggtgaagtaaacaaaataaaaaacgcacttctatcaaccaacaaagcagtagtatcactatcaaacggagtatccgtcttaacatttaaagttctagacctcaaaaactatatagacaaacaattactgccaatcctcaataaacaatcatgctcaataccaaacatcgaaacagtaatagaatttcaacaaaaaaacaacagactactagaaataacaagagaattttccgtcaacgccggcgtaactactccagtatcaacatatatgctaaccaactcagaactcctatccctcataaacgacatgccaataactaatgatcaaaaaaaactaatgtcaaacaatgtacaaatagttagacaacaatcatactcaatcatgtgcataataaaagaagaagtactagcatacgtcgtccaactacccctatacggagtaatagacacaccttgctggaaactacacacatcacccctatgcacaacaaatacaaaagaaggttccaacatctgcctaacaagaactgatagaggatggtactgcgacaacgccggatcagtatcattcttccctcaagctgaaacctgcaaagtacaatcaaacagagtattttgcgatacaatgaactccctaacacttccctcagaagttaatctttgtaatatagatatattcaacccaaaatacgactgcaaaataatgacaagtaaaacagacgtatcctcatctgtaattacatcactaggagccatagtatcttgctacggcaaaaccaaatgcacagcatcaaacaaaaacagaggtattatcaaaaccttctcaaacggatgtgactacgtttcaaacaaaggagtagacacagtatcagtcggaaacaccctatactgtgttaacaaacaagaaggacaatcactgtacgtaaaaggagaacccataataaatttctacgacccacttgtatttccatcagacgaatttgatgcatcaatctcacaagtaaatgaaaaaataaaccaatcattagcattcataagaaaatctgacgagttactacacaacgtaaatgttggcaaatcaacaaccaatataatgataacaacaataataatagtaataatagtcatattactcctcctcatagccgtcggattattcttatactgcaaagcaagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14597 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut1 (opt11)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactccccatactaaaaaccaacgccatcacaacaatcctcgccgccgtcacactctgcttcgccagctcccaaaacatcaccgaagagttctatcaatcaacctgctccgcagtctcaaagggatacctcggagccctccgcaccggatggtacacttccgtcatcacaatagaactctccaacatcaaagaaaacaaatgcaacggcaccgacgcaaaagtcaagctcatcaaacaagaactcgacaaatataaaaacgccgtcaccgaactccaactactcatgcaatccacacccgcggccggctcaggcagcgccatctgctcaggcatcgccgtctgcaaagtcctccacctcgaaggcgaagtcaacaaaatcaaaaacgcccttctttcaaccaacaaggcagtagtatccctctcaaacggcgtcagcgtcctgaccttcaaagtcctagacctcaaaaactacatagataaacaactcctccccatactgaacaaacaatcgtgctccatccccaatatcgaaaccgtcatagagttccagcagaaaaacaacagacttctcgaaataacccgagagttctcagtaaacgccggagtcaccacacccgtaagcacctacatgctcacaaactcagaactcctatccctcatcaacgacatgcccatcaccaacgaccagaaaaagctaatgtccaacaacgtccaaatagtacgccaacaaagctactcgataatgtgcatcatcaaggaagaagtactcgcctacgtcgtccaactccccctctacggcgtaatcgacacaccctgctggaaactccacacgtccccactctgcacaacaaacacaaaagaaggatccaacatatgcctaacccgcaccgacaggggctggtactgcgacaacgcaggctcagtcagcttctttccccaagccgaaacatgcaaagtccaatccaaccgtgtcttctgcgacaccatgaactcgctcaccctaccctcggaagtcaatctctgcaacatcgacatcttcaacccaaaatacgactgtaaaatcatgaccagcaaaacagacgtttcttccagcgtcatcacatcactcggcgcgatcgtatcatgctatggcaaaacaaagtgcaccgctagcaataaaaaccgaggaatcataaaaaccttcagcaacggctgcgactacgtatccaacaaaggcgtcgacaccgtatccgtcggaaacaccctctactgcgtcaacaagcaagaaggacaatcactctacgtcaaaggcgaaccaatcataaacttctacgacccactcgtattcccctcagacgagttcgacgcatccatctcccaagtcaacgaaaagatcaaccaatctctcgcctttatacgcaaaagcgacgaactccttcacaacgtaaacgtcggcaaaagcaccactaacataatgatcaccacaatcataatagtaatcatcgtaatactcctcctactcatcgccgtgggcctattcctctattgcaaagcccgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14598 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut1 (opt1)
  source 1..1907: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14599 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut1 (opt1)
  source 1..1907: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14600 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut1 (opt2)
  source 1..1907: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14601 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut1 (opt3)
  source 1..1907: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14602 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut1 (opt4)
  source 1..1907: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14603 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut1 (opt5)
  source 1..1907: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14604 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut1 (opt6)
  source 1..1907: mol_type = other RNA
gggagacccgtgacccggaagttgtacggctacgcgactttccctcccacaaaccctcgcgcccttcctttcctacttgggcccggcagaaagcttaccatggaattaccaatactaaaaacaaacgcaataacaacaattctagcagcagtaacattatgctttgcatcatcccaaaacatcacagaagaattttatcaatcaacctgctcagcagtttccaaaggatacttaggagcattaagaactggttggtacacttcagtaatcaccatcgaactctcaaacatcaaggaaaacaaatgcaacggaacagacgcaaaagttaaactcataaaacaagaacttgacaaatacaaaaacgccgtaacagaactacaacttctcatgcaatcaacacccgcagcaggatccggatcagccatatgctcaggcatagcagtatgtaaagtattacatcttgaaggtgaagtaaacaaaataaaaaacgcacttctatcaaccaacaaagcagtagtatcactatcaaacggagtatccgtcttaacatttaaagttctagacctcaaaaactatatagacaaacaattactgccaatcctcaataaacaatcatgctcaataccaaacatcgaaacagtaatagaatttcaacaaaaaaacaacagactactagaaataacaagagaattttccgtcaacgccggcgtaactactccagtatcaacatatatgctaaccaactcagaactcctatccctcataaacgacatgccaataactaatgatcaaaaaaaactaatgtcaaacaatgtacaaatagttagacaacaatcatactcaatcatgtgcataataaaagaagaagtactagcatacgtcgtccaactacccctatacggagtaatagacacaccttgctggaaactacacacatcacccctatgcacaacaaatacaaaagaaggttccaacatctgcctaacaagaactgatagaggatggtactgcgacaacgccggatcagtatcattcttccctcaagctgaaacctgcaaagtacaatcaaacagagtattttgcgatacaatgaactccctaacacttccctcagaagttaatctttgtaatatagatatattcaacccaaaatacgactgcaaaataatgacaagtaaaacagacgtatcctcatctgtaattacatcactaggagccatagtatcttgctacggcaaaaccaaatgcacagcatcaaacaaaaacagaggtattatcaaaaccttctcaaacggatgtgactacgtttcaaacaaaggagtagacacagtatcagtcggaaacaccctatactgtgttaacaaacaagaaggacaatcactgtacgtaaaaggagaacccataataaatttctacgacccacttgtatttccatcagacgaatttgatgcatcaatctcacaagtaaatgaaaaaataaaccaatcattagcattcataagaaaatctgacgagttactacacaacgtaaatgttggcaaatcaacaaccaatataatgataacaacaataataatagtaataatagtcatattactcctcctcatagccgtcggattattcttatactgcaaagcaagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14605 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut1 (opt11)
  source 1..1907: mol_type = other RNA
gggagacccgtgacccggaagttgtacggctacgcgactttccctcccacaaaccctcgcgcccttcctttcctacttgggcccggcagaaagcttaccatggaactccccatactaaaaaccaacgccatcacaacaatcctcgccgccgtcacactctgcttcgccagctcccaaaacatcaccgaagagttctatcaatcaacctgctccgcagtctcaaagggatacctcggagccctccgcaccggatggtacacttccgtcatcacaatagaactctccaacatcaaagaaaacaaatgcaacggcaccgacgcaaaagtcaagctcatcaaacaagaactcgacaaatataaaaacgccgtcaccgaactccaactactcatgcaatccacacccgcggccggctcaggcagcgccatctgctcaggcatcgccgtctgcaaagtcctccacctcgaaggcgaagtcaacaaaatcaaaaacgcccttctttcaaccaacaaggcagtagtatccctctcaaacggcgtcagcgtcctgaccttcaaagtcctagacctcaaaaactacatagataaacaactcctccccatactgaacaaacaatcgtgctccatccccaatatcgaaaccgtcatagagttccagcagaaaaacaacagacttctcgaaataacccgagagttctcagtaaacgccggagtcaccacacccgtaagcacctacatgctcacaaactcagaactcctatccctcatcaacgacatgcccatcaccaacgaccagaaaaagctaatgtccaacaacgtccaaatagtacgccaacaaagctactcgataatgtgcatcatcaaggaagaagtactcgcctacgtcgtccaactccccctctacggcgtaatcgacacaccctgctggaaactccacacgtccccactctgcacaacaaacacaaaagaaggatccaacatatgcctaacccgcaccgacaggggctggtactgcgacaacgcaggctcagtcagcttctttccccaagccgaaacatgcaaagtccaatccaaccgtgtcttctgcgacaccatgaactcgctcaccctaccctcggaagtcaatctctgcaacatcgacatcttcaacccaaaatacgactgtaaaatcatgaccagcaaaacagacgtttcttccagcgtcatcacatcactcggcgcgatcgtatcatgctatggcaaaacaaagtgcaccgctagcaataaaaaccgaggaatcataaaaaccttcagcaacggctgcgactacgtatccaacaaaggcgtcgacaccgtatccgtcggaaacaccctctactgcgtcaacaagcaagaaggacaatcactctacgtcaaaggcgaaccaatcataaacttctacgacccactcgtattcccctcagacgagttcgacgcatccatctcccaagtcaacgaaaagatcaaccaatctctcgcctttatacgcaaaagcgacgaactccttcacaacgtaaacgtcggcaaaagcaccactaacataatgatcaccacaatcataatagtaatcatcgtaatactcctcctactcatcgccgtgggcctattcctctattgcaaagcccgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14606 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut1 (opt1)
  source 1..1923: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14607 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut1 (opt1)
  source 1..1923: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14608 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut1 (opt2)
  source 1..1923: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14609 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut1 (opt3)
  source 1..1923: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14610 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut1 (opt4)
  source 1..1923: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14611 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut1 (opt5)
  source 1..1923: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14612 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut1 (opt6)
  source 1..1923: mol_type = other RNA
gggagacccgtgacccggaagttgtacggctacgcgactttccctcccacaaaccctcgcgcccttcctttcctacttgggcccggcagaaagcttaccatggaattaccaatactaaaaacaaacgcaataacaacaattctagcagcagtaacattatgctttgcatcatcccaaaacatcacagaagaattttatcaatcaacctgctcagcagtttccaaaggatacttaggagcattaagaactggttggtacacttcagtaatcaccatcgaactctcaaacatcaaggaaaacaaatgcaacggaacagacgcaaaagttaaactcataaaacaagaacttgacaaatacaaaaacgccgtaacagaactacaacttctcatgcaatcaacacccgcagcaggatccggatcagccatatgctcaggcatagcagtatgtaaagtattacatcttgaaggtgaagtaaacaaaataaaaaacgcacttctatcaaccaacaaagcagtagtatcactatcaaacggagtatccgtcttaacatttaaagttctagacctcaaaaactatatagacaaacaattactgccaatcctcaataaacaatcatgctcaataccaaacatcgaaacagtaatagaatttcaacaaaaaaacaacagactactagaaataacaagagaattttccgtcaacgccggcgtaactactccagtatcaacatatatgctaaccaactcagaactcctatccctcataaacgacatgccaataactaatgatcaaaaaaaactaatgtcaaacaatgtacaaatagttagacaacaatcatactcaatcatgtgcataataaaagaagaagtactagcatacgtcgtccaactacccctatacggagtaatagacacaccttgctggaaactacacacatcacccctatgcacaacaaatacaaaagaaggttccaacatctgcctaacaagaactgatagaggatggtactgcgacaacgccggatcagtatcattcttccctcaagctgaaacctgcaaagtacaatcaaacagagtattttgcgatacaatgaactccctaacacttccctcagaagttaatctttgtaatatagatatattcaacccaaaatacgactgcaaaataatgacaagtaaaacagacgtatcctcatctgtaattacatcactaggagccatagtatcttgctacggcaaaaccaaatgcacagcatcaaacaaaaacagaggtattatcaaaaccttctcaaacggatgtgactacgtttcaaacaaaggagtagacacagtatcagtcggaaacaccctatactgtgttaacaaacaagaaggacaatcactgtacgtaaaaggagaacccataataaatttctacgacccacttgtatttccatcagacgaatttgatgcatcaatctcacaagtaaatgaaaaaataaaccaatcattagcattcataagaaaatctgacgagttactacacaacgtaaatgttggcaaatcaacaaccaatataatgataacaacaataataatagtaataatagtcatattactcctcctcatagccgtcggattattcttatactgcaaagcaagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14613 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut1 (opt11)
  source 1..1923: mol_type = other RNA
gggagacccgtgacccggaagttgtacggctacgcgactttccctcccacaaaccctcgcgcccttcctttcctacttgggcccggcagaaagcttaccatggaactccccatactaaaaaccaacgccatcacaacaatcctcgccgccgtcacactctgcttcgccagctcccaaaacatcaccgaagagttctatcaatcaacctgctccgcagtctcaaagggatacctcggagccctccgcaccggatggtacacttccgtcatcacaatagaactctccaacatcaaagaaaacaaatgcaacggcaccgacgcaaaagtcaagctcatcaaacaagaactcgacaaatataaaaacgccgtcaccgaactccaactactcatgcaatccacacccgcggccggctcaggcagcgccatctgctcaggcatcgccgtctgcaaagtcctccacctcgaaggcgaagtcaacaaaatcaaaaacgcccttctttcaaccaacaaggcagtagtatccctctcaaacggcgtcagcgtcctgaccttcaaagtcctagacctcaaaaactacatagataaacaactcctccccatactgaacaaacaatcgtgctccatccccaatatcgaaaccgtcatagagttccagcagaaaaacaacagacttctcgaaataacccgagagttctcagtaaacgccggagtcaccacacccgtaagcacctacatgctcacaaactcagaactcctatccctcatcaacgacatgcccatcaccaacgaccagaaaaagctaatgtccaacaacgtccaaatagtacgccaacaaagctactcgataatgtgcatcatcaaggaagaagtactcgcctacgtcgtccaactccccctctacggcgtaatcgacacaccctgctggaaactccacacgtccccactctgcacaacaaacacaaaagaaggatccaacatatgcctaacccgcaccgacaggggctggtactgcgacaacgcaggctcagtcagcttctttccccaagccgaaacatgcaaagtccaatccaaccgtgtcttctgcgacaccatgaactcgctcaccctaccctcggaagtcaatctctgcaacatcgacatcttcaacccaaaatacgactgtaaaatcatgaccagcaaaacagacgtttcttccagcgtcatcacatcactcggcgcgatcgtatcatgctatggcaaaacaaagtgcaccgctagcaataaaaaccgaggaatcataaaaaccttcagcaacggctgcgactacgtatccaacaaaggcgtcgacaccgtatccgtcggaaacaccctctactgcgtcaacaagcaagaaggacaatcactctacgtcaaaggcgaaccaatcataaacttctacgacccactcgtattcccctcagacgagttcgacgcatccatctcccaagtcaacgaaaagatcaaccaatctctcgcctttatacgcaaaagcgacgaactccttcacaacgtaaacgtcggcaaaagcaccactaacataatgatcaccacaatcataatagtaatcatcgtaatactcctcctactcatcgccgtgggcctattcctctattgcaaagcccgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14614 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut1 (opt1)
  source 1..2139: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14615 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut1 (opt1)
  source 1..2139: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14616 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut1 (opt2)
  source 1..2139: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14617 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut1 (opt3)
  source 1..2139: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14618 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut1 (opt4)
  source 1..2139: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14619 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut1 (opt5)
  source 1..2139: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14620 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut1 (opt6)
  source 1..2139: mol_type = other RNA
gggagacccgtgacccggaagttgtacggctacgcgactttccctcccacaaaccctcgcgcccttcctttcctacttgggcccggcagaaagcttaccatggaattaccaatactaaaaacaaacgcaataacaacaattctagcagcagtaacattatgctttgcatcatcccaaaacatcacagaagaattttatcaatcaacctgctcagcagtttccaaaggatacttaggagcattaagaactggttggtacacttcagtaatcaccatcgaactctcaaacatcaaggaaaacaaatgcaacggaacagacgcaaaagttaaactcataaaacaagaacttgacaaatacaaaaacgccgtaacagaactacaacttctcatgcaatcaacacccgcagcaggatccggatcagccatatgctcaggcatagcagtatgtaaagtattacatcttgaaggtgaagtaaacaaaataaaaaacgcacttctatcaaccaacaaagcagtagtatcactatcaaacggagtatccgtcttaacatttaaagttctagacctcaaaaactatatagacaaacaattactgccaatcctcaataaacaatcatgctcaataccaaacatcgaaacagtaatagaatttcaacaaaaaaacaacagactactagaaataacaagagaattttccgtcaacgccggcgtaactactccagtatcaacatatatgctaaccaactcagaactcctatccctcataaacgacatgccaataactaatgatcaaaaaaaactaatgtcaaacaatgtacaaatagttagacaacaatcatactcaatcatgtgcataataaaagaagaagtactagcatacgtcgtccaactacccctatacggagtaatagacacaccttgctggaaactacacacatcacccctatgcacaacaaatacaaaagaaggttccaacatctgcctaacaagaactgatagaggatggtactgcgacaacgccggatcagtatcattcttccctcaagctgaaacctgcaaagtacaatcaaacagagtattttgcgatacaatgaactccctaacacttccctcagaagttaatctttgtaatatagatatattcaacccaaaatacgactgcaaaataatgacaagtaaaacagacgtatcctcatctgtaattacatcactaggagccatagtatcttgctacggcaaaaccaaatgcacagcatcaaacaaaaacagaggtattatcaaaaccttctcaaacggatgtgactacgtttcaaacaaaggagtagacacagtatcagtcggaaacaccctatactgtgttaacaaacaagaaggacaatcactgtacgtaaaaggagaacccataataaatttctacgacccacttgtatttccatcagacgaatttgatgcatcaatctcacaagtaaatgaaaaaataaaccaatcattagcattcataagaaaatctgacgagttactacacaacgtaaatgttggcaaatcaacaaccaatataatgataacaacaataataatagtaataatagtcatattactcctcctcatagccgtcggattattcttatactgcaaagcaagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14621 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut1 (opt11)
  source 1..2139: mol_type = other RNA
gggagacccgtgacccggaagttgtacggctacgcgactttccctcccacaaaccctcgcgcccttcctttcctacttgggcccggcagaaagcttaccatggaactccccatactaaaaaccaacgccatcacaacaatcctcgccgccgtcacactctgcttcgccagctcccaaaacatcaccgaagagttctatcaatcaacctgctccgcagtctcaaagggatacctcggagccctccgcaccggatggtacacttccgtcatcacaatagaactctccaacatcaaagaaaacaaatgcaacggcaccgacgcaaaagtcaagctcatcaaacaagaactcgacaaatataaaaacgccgtcaccgaactccaactactcatgcaatccacacccgcggccggctcaggcagcgccatctgctcaggcatcgccgtctgcaaagtcctccacctcgaaggcgaagtcaacaaaatcaaaaacgcccttctttcaaccaacaaggcagtagtatccctctcaaacggcgtcagcgtcctgaccttcaaagtcctagacctcaaaaactacatagataaacaactcctccccatactgaacaaacaatcgtgctccatccccaatatcgaaaccgtcatagagttccagcagaaaaacaacagacttctcgaaataacccgagagttctcagtaaacgccggagtcaccacacccgtaagcacctacatgctcacaaactcagaactcctatccctcatcaacgacatgcccatcaccaacgaccagaaaaagctaatgtccaacaacgtccaaatagtacgccaacaaagctactcgataatgtgcatcatcaaggaagaagtactcgcctacgtcgtccaactccccctctacggcgtaatcgacacaccctgctggaaactccacacgtccccactctgcacaacaaacacaaaagaaggatccaacatatgcctaacccgcaccgacaggggctggtactgcgacaacgcaggctcagtcagcttctttccccaagccgaaacatgcaaagtccaatccaaccgtgtcttctgcgacaccatgaactcgctcaccctaccctcggaagtcaatctctgcaacatcgacatcttcaacccaaaatacgactgtaaaatcatgaccagcaaaacagacgtttcttccagcgtcatcacatcactcggcgcgatcgtatcatgctatggcaaaacaaagtgcaccgctagcaataaaaaccgaggaatcataaaaaccttcagcaacggctgcgactacgtatccaacaaaggcgtcgacaccgtatccgtcggaaacaccctctactgcgtcaacaagcaagaaggacaatcactctacgtcaaaggcgaaccaatcataaacttctacgacccactcgtattcccctcagacgagttcgacgcatccatctcccaagtcaacgaaaagatcaaccaatctctcgcctttatacgcaaaagcgacgaactccttcacaacgtaaacgtcggcaaaagcaccactaacataatgatcaccacaatcataatagtaatcatcgtaatactcctcctactcatcgccgtgggcctattcctctattgcaaagcccgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14622 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut1 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14623 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut1 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14624 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut1 (opt2)
  source 1..1919: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14625 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut1 (opt3)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14626 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut1 (opt4)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14627 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut1 (opt5)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14628 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut1 (opt6)
  source 1..1919: mol_type = other RNA
gggagacccgtgacccggaagttgtacggctacgcgactttccctcccacaaaccctcgcgcccttcctttcctacttgggcccggcagaaagcttaccatggaattaccaatactaaaaacaaacgcaataacaacaattctagcagcagtaacattatgctttgcatcatcccaaaacatcacagaagaattttatcaatcaacctgctcagcagtttccaaaggatacttaggagcattaagaactggttggtacacttcagtaatcaccatcgaactctcaaacatcaaggaaaacaaatgcaacggaacagacgcaaaagttaaactcataaaacaagaacttgacaaatacaaaaacgccgtaacagaactacaacttctcatgcaatcaacacccgcagcaggatccggatcagccatatgctcaggcatagcagtatgtaaagtattacatcttgaaggtgaagtaaacaaaataaaaaacgcacttctatcaaccaacaaagcagtagtatcactatcaaacggagtatccgtcttaacatttaaagttctagacctcaaaaactatatagacaaacaattactgccaatcctcaataaacaatcatgctcaataccaaacatcgaaacagtaatagaatttcaacaaaaaaacaacagactactagaaataacaagagaattttccgtcaacgccggcgtaactactccagtatcaacatatatgctaaccaactcagaactcctatccctcataaacgacatgccaataactaatgatcaaaaaaaactaatgtcaaacaatgtacaaatagttagacaacaatcatactcaatcatgtgcataataaaagaagaagtactagcatacgtcgtccaactacccctatacggagtaatagacacaccttgctggaaactacacacatcacccctatgcacaacaaatacaaaagaaggttccaacatctgcctaacaagaactgatagaggatggtactgcgacaacgccggatcagtatcattcttccctcaagctgaaacctgcaaagtacaatcaaacagagtattttgcgatacaatgaactccctaacacttccctcagaagttaatctttgtaatatagatatattcaacccaaaatacgactgcaaaataatgacaagtaaaacagacgtatcctcatctgtaattacatcactaggagccatagtatcttgctacggcaaaaccaaatgcacagcatcaaacaaaaacagaggtattatcaaaaccttctcaaacggatgtgactacgtttcaaacaaaggagtagacacagtatcagtcggaaacaccctatactgtgttaacaaacaagaaggacaatcactgtacgtaaaaggagaacccataataaatttctacgacccacttgtatttccatcagacgaatttgatgcatcaatctcacaagtaaatgaaaaaataaaccaatcattagcattcataagaaaatctgacgagttactacacaacgtaaatgttggcaaatcaacaaccaatataatgataacaacaataataatagtaataatagtcatattactcctcctcatagccgtcggattattcttatactgcaaagcaagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14629 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut1 (opt11)
  source 1..1919: mol_type = other RNA
gggagacccgtgacccggaagttgtacggctacgcgactttccctcccacaaaccctcgcgcccttcctttcctacttgggcccggcagaaagcttaccatggaactccccatactaaaaaccaacgccatcacaacaatcctcgccgccgtcacactctgcttcgccagctcccaaaacatcaccgaagagttctatcaatcaacctgctccgcagtctcaaagggatacctcggagccctccgcaccggatggtacacttccgtcatcacaatagaactctccaacatcaaagaaaacaaatgcaacggcaccgacgcaaaagtcaagctcatcaaacaagaactcgacaaatataaaaacgccgtcaccgaactccaactactcatgcaatccacacccgcggccggctcaggcagcgccatctgctcaggcatcgccgtctgcaaagtcctccacctcgaaggcgaagtcaacaaaatcaaaaacgcccttctttcaaccaacaaggcagtagtatccctctcaaacggcgtcagcgtcctgaccttcaaagtcctagacctcaaaaactacatagataaacaactcctccccatactgaacaaacaatcgtgctccatccccaatatcgaaaccgtcatagagttccagcagaaaaacaacagacttctcgaaataacccgagagttctcagtaaacgccggagtcaccacacccgtaagcacctacatgctcacaaactcagaactcctatccctcatcaacgacatgcccatcaccaacgaccagaaaaagctaatgtccaacaacgtccaaatagtacgccaacaaagctactcgataatgtgcatcatcaaggaagaagtactcgcctacgtcgtccaactccccctctacggcgtaatcgacacaccctgctggaaactccacacgtccccactctgcacaacaaacacaaaagaaggatccaacatatgcctaacccgcaccgacaggggctggtactgcgacaacgcaggctcagtcagcttctttccccaagccgaaacatgcaaagtccaatccaaccgtgtcttctgcgacaccatgaactcgctcaccctaccctcggaagtcaatctctgcaacatcgacatcttcaacccaaaatacgactgtaaaatcatgaccagcaaaacagacgtttcttccagcgtcatcacatcactcggcgcgatcgtatcatgctatggcaaaacaaagtgcaccgctagcaataaaaaccgaggaatcataaaaaccttcagcaacggctgcgactacgtatccaacaaaggcgtcgacaccgtatccgtcggaaacaccctctactgcgtcaacaagcaagaaggacaatcactctacgtcaaaggcgaaccaatcataaacttctacgacccactcgtattcccctcagacgagttcgacgcatccatctcccaagtcaacgaaaagatcaaccaatctctcgcctttatacgcaaaagcgacgaactccttcacaacgtaaacgtcggcaaaagcaccactaacataatgatcaccacaatcataatagtaatcatcgtaatactcctcctactcatcgccgtgggcctattcctctattgcaaagcccgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14630 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut1 (opt1)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14631 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut1 (opt1)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14632 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut1 (opt2)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14633 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut1 (opt3)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14634 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut1 (opt4)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14635 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut1 (opt5)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14636 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut1 (opt6)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattaccaatactaaaaacaaacgcaataacaacaattctagcagcagtaacattatgctttgcatcatcccaaaacatcacagaagaattttatcaatcaacctgctcagcagtttccaaaggatacttaggagcattaagaactggttggtacacttcagtaatcaccatcgaactctcaaacatcaaggaaaacaaatgcaacggaacagacgcaaaagttaaactcataaaacaagaacttgacaaatacaaaaacgccgtaacagaactacaacttctcatgcaatcaacacccgcagcaggatccggatcagccatatgctcaggcatagcagtatgtaaagtattacatcttgaaggtgaagtaaacaaaataaaaaacgcacttctatcaaccaacaaagcagtagtatcactatcaaacggagtatccgtcttaacatttaaagttctagacctcaaaaactatatagacaaacaattactgccaatcctcaataaacaatcatgctcaataccaaacatcgaaacagtaatagaatttcaacaaaaaaacaacagactactagaaataacaagagaattttccgtcaacgccggcgtaactactccagtatcaacatatatgctaaccaactcagaactcctatccctcataaacgacatgccaataactaatgatcaaaaaaaactaatgtcaaacaatgtacaaatagttagacaacaatcatactcaatcatgtgcataataaaagaagaagtactagcatacgtcgtccaactacccctatacggagtaatagacacaccttgctggaaactacacacatcacccctatgcacaacaaatacaaaagaaggttccaacatctgcctaacaagaactgatagaggatggtactgcgacaacgccggatcagtatcattcttccctcaagctgaaacctgcaaagtacaatcaaacagagtattttgcgatacaatgaactccctaacacttccctcagaagttaatctttgtaatatagatatattcaacccaaaatacgactgcaaaataatgacaagtaaaacagacgtatcctcatctgtaattacatcactaggagccatagtatcttgctacggcaaaaccaaatgcacagcatcaaacaaaaacagaggtattatcaaaaccttctcaaacggatgtgactacgtttcaaacaaaggagtagacacagtatcagtcggaaacaccctatactgtgttaacaaacaagaaggacaatcactgtacgtaaaaggagaacccataataaatttctacgacccacttgtatttccatcagacgaatttgatgcatcaatctcacaagtaaatgaaaaaataaaccaatcattagcattcataagaaaatctgacgagttactacacaacgtaaatgttggcaaatcaacaaccaatataatgataacaacaataataatagtaataatagtcatattactcctcctcatagccgtcggattattcttatactgcaaagcaagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14637 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut1 (opt11)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatactaaaaaccaacgccatcacaacaatcctcgccgccgtcacactctgcttcgccagctcccaaaacatcaccgaagagttctatcaatcaacctgctccgcagtctcaaagggatacctcggagccctccgcaccggatggtacacttccgtcatcacaatagaactctccaacatcaaagaaaacaaatgcaacggcaccgacgcaaaagtcaagctcatcaaacaagaactcgacaaatataaaaacgccgtcaccgaactccaactactcatgcaatccacacccgcggccggctcaggcagcgccatctgctcaggcatcgccgtctgcaaagtcctccacctcgaaggcgaagtcaacaaaatcaaaaacgcccttctttcaaccaacaaggcagtagtatccctctcaaacggcgtcagcgtcctgaccttcaaagtcctagacctcaaaaactacatagataaacaactcctccccatactgaacaaacaatcgtgctccatccccaatatcgaaaccgtcatagagttccagcagaaaaacaacagacttctcgaaataacccgagagttctcagtaaacgccggagtcaccacacccgtaagcacctacatgctcacaaactcagaactcctatccctcatcaacgacatgcccatcaccaacgaccagaaaaagctaatgtccaacaacgtccaaatagtacgccaacaaagctactcgataatgtgcatcatcaaggaagaagtactcgcctacgtcgtccaactccccctctacggcgtaatcgacacaccctgctggaaactccacacgtccccactctgcacaacaaacacaaaagaaggatccaacatatgcctaacccgcaccgacaggggctggtactgcgacaacgcaggctcagtcagcttctttccccaagccgaaacatgcaaagtccaatccaaccgtgtcttctgcgacaccatgaactcgctcaccctaccctcggaagtcaatctctgcaacatcgacatcttcaacccaaaatacgactgtaaaatcatgaccagcaaaacagacgtttcttccagcgtcatcacatcactcggcgcgatcgtatcatgctatggcaaaacaaagtgcaccgctagcaataaaaaccgaggaatcataaaaaccttcagcaacggctgcgactacgtatccaacaaaggcgtcgacaccgtatccgtcggaaacaccctctactgcgtcaacaagcaagaaggacaatcactctacgtcaaaggcgaaccaatcataaacttctacgacccactcgtattcccctcagacgagttcgacgcatccatctcccaagtcaacgaaaagatcaaccaatctctcgcctttatacgcaaaagcgacgaactccttcacaacgtaaacgtcggcaaaagcaccactaacataatgatcaccacaatcataatagtaatcatcgtaatactcctcctactcatcgccgtgggcctattcctctattgcaaagcccgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14638 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut1 (opt1)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14639 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut1 (opt1)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14640 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut1 (opt2)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14641 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut1 (opt3)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14642 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut1 (opt4)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14643 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut1 (opt5)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14644 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut1 (opt6)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattaccaatactaaaaacaaacgcaataacaacaattctagcagcagtaacattatgctttgcatcatcccaaaacatcacagaagaattttatcaatcaacctgctcagcagtttccaaaggatacttaggagcattaagaactggttggtacacttcagtaatcaccatcgaactctcaaacatcaaggaaaacaaatgcaacggaacagacgcaaaagttaaactcataaaacaagaacttgacaaatacaaaaacgccgtaacagaactacaacttctcatgcaatcaacacccgcagcaggatccggatcagccatatgctcaggcatagcagtatgtaaagtattacatcttgaaggtgaagtaaacaaaataaaaaacgcacttctatcaaccaacaaagcagtagtatcactatcaaacggagtatccgtcttaacatttaaagttctagacctcaaaaactatatagacaaacaattactgccaatcctcaataaacaatcatgctcaataccaaacatcgaaacagtaatagaatttcaacaaaaaaacaacagactactagaaataacaagagaattttccgtcaacgccggcgtaactactccagtatcaacatatatgctaaccaactcagaactcctatccctcataaacgacatgccaataactaatgatcaaaaaaaactaatgtcaaacaatgtacaaatagttagacaacaatcatactcaatcatgtgcataataaaagaagaagtactagcatacgtcgtccaactacccctatacggagtaatagacacaccttgctggaaactacacacatcacccctatgcacaacaaatacaaaagaaggttccaacatctgcctaacaagaactgatagaggatggtactgcgacaacgccggatcagtatcattcttccctcaagctgaaacctgcaaagtacaatcaaacagagtattttgcgatacaatgaactccctaacacttccctcagaagttaatctttgtaatatagatatattcaacccaaaatacgactgcaaaataatgacaagtaaaacagacgtatcctcatctgtaattacatcactaggagccatagtatcttgctacggcaaaaccaaatgcacagcatcaaacaaaaacagaggtattatcaaaaccttctcaaacggatgtgactacgtttcaaacaaaggagtagacacagtatcagtcggaaacaccctatactgtgttaacaaacaagaaggacaatcactgtacgtaaaaggagaacccataataaatttctacgacccacttgtatttccatcagacgaatttgatgcatcaatctcacaagtaaatgaaaaaataaaccaatcattagcattcataagaaaatctgacgagttactacacaacgtaaatgttggcaaatcaacaaccaatataatgataacaacaataataatagtaataatagtcatattactcctcctcatagccgtcggattattcttatactgcaaagcaagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14645 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut1 (opt11)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatactaaaaaccaacgccatcacaacaatcctcgccgccgtcacactctgcttcgccagctcccaaaacatcaccgaagagttctatcaatcaacctgctccgcagtctcaaagggatacctcggagccctccgcaccggatggtacacttccgtcatcacaatagaactctccaacatcaaagaaaacaaatgcaacggcaccgacgcaaaagtcaagctcatcaaacaagaactcgacaaatataaaaacgccgtcaccgaactccaactactcatgcaatccacacccgcggccggctcaggcagcgccatctgctcaggcatcgccgtctgcaaagtcctccacctcgaaggcgaagtcaacaaaatcaaaaacgcccttctttcaaccaacaaggcagtagtatccctctcaaacggcgtcagcgtcctgaccttcaaagtcctagacctcaaaaactacatagataaacaactcctccccatactgaacaaacaatcgtgctccatccccaatatcgaaaccgtcatagagttccagcagaaaaacaacagacttctcgaaataacccgagagttctcagtaaacgccggagtcaccacacccgtaagcacctacatgctcacaaactcagaactcctatccctcatcaacgacatgcccatcaccaacgaccagaaaaagctaatgtccaacaacgtccaaatagtacgccaacaaagctactcgataatgtgcatcatcaaggaagaagtactcgcctacgtcgtccaactccccctctacggcgtaatcgacacaccctgctggaaactccacacgtccccactctgcacaacaaacacaaaagaaggatccaacatatgcctaacccgcaccgacaggggctggtactgcgacaacgcaggctcagtcagcttctttccccaagccgaaacatgcaaagtccaatccaaccgtgtcttctgcgacaccatgaactcgctcaccctaccctcggaagtcaatctctgcaacatcgacatcttcaacccaaaatacgactgtaaaatcatgaccagcaaaacagacgtttcttccagcgtcatcacatcactcggcgcgatcgtatcatgctatggcaaaacaaagtgcaccgctagcaataaaaaccgaggaatcataaaaaccttcagcaacggctgcgactacgtatccaacaaaggcgtcgacaccgtatccgtcggaaacaccctctactgcgtcaacaagcaagaaggacaatcactctacgtcaaaggcgaaccaatcataaacttctacgacccactcgtattcccctcagacgagttcgacgcatccatctcccaagtcaacgaaaagatcaaccaatctctcgcctttatacgcaaaagcgacgaactccttcacaacgtaaacgtcggcaaaagcaccactaacataatgatcaccacaatcataatagtaatcatcgtaatactcctcctactcatcgccgtgggcctattcctctattgcaaagcccgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14646 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut1 (opt1)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14647 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut1 (opt1)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14648 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut1 (opt2)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14649 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut1 (opt3)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14650 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut1 (opt4)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14651 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut1 (opt5)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14652 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut1 (opt6)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattaccaatactaaaaacaaacgcaataacaacaattctagcagcagtaacattatgctttgcatcatcccaaaacatcacagaagaattttatcaatcaacctgctcagcagtttccaaaggatacttaggagcattaagaactggttggtacacttcagtaatcaccatcgaactctcaaacatcaaggaaaacaaatgcaacggaacagacgcaaaagttaaactcataaaacaagaacttgacaaatacaaaaacgccgtaacagaactacaacttctcatgcaatcaacacccgcagcaggatccggatcagccatatgctcaggcatagcagtatgtaaagtattacatcttgaaggtgaagtaaacaaaataaaaaacgcacttctatcaaccaacaaagcagtagtatcactatcaaacggagtatccgtcttaacatttaaagttctagacctcaaaaactatatagacaaacaattactgccaatcctcaataaacaatcatgctcaataccaaacatcgaaacagtaatagaatttcaacaaaaaaacaacagactactagaaataacaagagaattttccgtcaacgccggcgtaactactccagtatcaacatatatgctaaccaactcagaactcctatccctcataaacgacatgccaataactaatgatcaaaaaaaactaatgtcaaacaatgtacaaatagttagacaacaatcatactcaatcatgtgcataataaaagaagaagtactagcatacgtcgtccaactacccctatacggagtaatagacacaccttgctggaaactacacacatcacccctatgcacaacaaatacaaaagaaggttccaacatctgcctaacaagaactgatagaggatggtactgcgacaacgccggatcagtatcattcttccctcaagctgaaacctgcaaagtacaatcaaacagagtattttgcgatacaatgaactccctaacacttccctcagaagttaatctttgtaatatagatatattcaacccaaaatacgactgcaaaataatgacaagtaaaacagacgtatcctcatctgtaattacatcactaggagccatagtatcttgctacggcaaaaccaaatgcacagcatcaaacaaaaacagaggtattatcaaaaccttctcaaacggatgtgactacgtttcaaacaaaggagtagacacagtatcagtcggaaacaccctatactgtgttaacaaacaagaaggacaatcactgtacgtaaaaggagaacccataataaatttctacgacccacttgtatttccatcagacgaatttgatgcatcaatctcacaagtaaatgaaaaaataaaccaatcattagcattcataagaaaatctgacgagttactacacaacgtaaatgttggcaaatcaacaaccaatataatgataacaacaataataatagtaataatagtcatattactcctcctcatagccgtcggattattcttatactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14653 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut1 (opt11)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatactaaaaaccaacgccatcacaacaatcctcgccgccgtcacactctgcttcgccagctcccaaaacatcaccgaagagttctatcaatcaacctgctccgcagtctcaaagggatacctcggagccctccgcaccggatggtacacttccgtcatcacaatagaactctccaacatcaaagaaaacaaatgcaacggcaccgacgcaaaagtcaagctcatcaaacaagaactcgacaaatataaaaacgccgtcaccgaactccaactactcatgcaatccacacccgcggccggctcaggcagcgccatctgctcaggcatcgccgtctgcaaagtcctccacctcgaaggcgaagtcaacaaaatcaaaaacgcccttctttcaaccaacaaggcagtagtatccctctcaaacggcgtcagcgtcctgaccttcaaagtcctagacctcaaaaactacatagataaacaactcctccccatactgaacaaacaatcgtgctccatccccaatatcgaaaccgtcatagagttccagcagaaaaacaacagacttctcgaaataacccgagagttctcagtaaacgccggagtcaccacacccgtaagcacctacatgctcacaaactcagaactcctatccctcatcaacgacatgcccatcaccaacgaccagaaaaagctaatgtccaacaacgtccaaatagtacgccaacaaagctactcgataatgtgcatcatcaaggaagaagtactcgcctacgtcgtccaactccccctctacggcgtaatcgacacaccctgctggaaactccacacgtccccactctgcacaacaaacacaaaagaaggatccaacatatgcctaacccgcaccgacaggggctggtactgcgacaacgcaggctcagtcagcttctttccccaagccgaaacatgcaaagtccaatccaaccgtgtcttctgcgacaccatgaactcgctcaccctaccctcggaagtcaatctctgcaacatcgacatcttcaacccaaaatacgactgtaaaatcatgaccagcaaaacagacgtttcttccagcgtcatcacatcactcggcgcgatcgtatcatgctatggcaaaacaaagtgcaccgctagcaataaaaaccgaggaatcataaaaaccttcagcaacggctgcgactacgtatccaacaaaggcgtcgacaccgtatccgtcggaaacaccctctactgcgtcaacaagcaagaaggacaatcactctacgtcaaaggcgaaccaatcataaacttctacgacccactcgtattcccctcagacgagttcgacgcatccatctcccaagtcaacgaaaagatcaaccaatctctcgcctttatacgcaaaagcgacgaactccttcacaacgtaaacgtcggcaaaagcaccactaacataatgatcaccacaatcataatagtaatcatcgtaatactcctcctactcatcgccgtgggcctattcctctattgcaaagcccgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14654 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut1 (opt1)
  source 1..1931: mol_type = other RNA
gggagaggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14655 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut1 (opt1)
  source 1..1931: mol_type = other RNA
gggagaggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14656 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut1 (opt2)
  source 1..1931: mol_type = other RNA
gggagaggcgctgcctacggaggtggcagccatctccttctcggcatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14657 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut1 (opt3)
  source 1..1931: mol_type = other RNA
gggagaggcgctgcctacggaggtggcagccatctccttctcggcatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14658 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut1 (opt4)
  source 1..1931: mol_type = other RNA
gggagaggcgctgcctacggaggtggcagccatctccttctcggcatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14659 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut1 (opt5)
  source 1..1931: mol_type = other RNA
gggagaggcgctgcctacggaggtggcagccatctccttctcggcatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14660 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut1 (opt6)
  source 1..1931: mol_type = other RNA
gggagaggcgctgcctacggaggtggcagccatctccttctcggcatcaagcttaccatggaattaccaatactaaaaacaaacgcaataacaacaattctagcagcagtaacattatgctttgcatcatcccaaaacatcacagaagaattttatcaatcaacctgctcagcagtttccaaaggatacttaggagcattaagaactggttggtacacttcagtaatcaccatcgaactctcaaacatcaaggaaaacaaatgcaacggaacagacgcaaaagttaaactcataaaacaagaacttgacaaatacaaaaacgccgtaacagaactacaacttctcatgcaatcaacacccgcagcaggatccggatcagccatatgctcaggcatagcagtatgtaaagtattacatcttgaaggtgaagtaaacaaaataaaaaacgcacttctatcaaccaacaaagcagtagtatcactatcaaacggagtatccgtcttaacatttaaagttctagacctcaaaaactatatagacaaacaattactgccaatcctcaataaacaatcatgctcaataccaaacatcgaaacagtaatagaatttcaacaaaaaaacaacagactactagaaataacaagagaattttccgtcaacgccggcgtaactactccagtatcaacatatatgctaaccaactcagaactcctatccctcataaacgacatgccaataactaatgatcaaaaaaaactaatgtcaaacaatgtacaaatagttagacaacaatcatactcaatcatgtgcataataaaagaagaagtactagcatacgtcgtccaactacccctatacggagtaatagacacaccttgctggaaactacacacatcacccctatgcacaacaaatacaaaagaaggttccaacatctgcctaacaagaactgatagaggatggtactgcgacaacgccggatcagtatcattcttccctcaagctgaaacctgcaaagtacaatcaaacagagtattttgcgatacaatgaactccctaacacttccctcagaagttaatctttgtaatatagatatattcaacccaaaatacgactgcaaaataatgacaagtaaaacagacgtatcctcatctgtaattacatcactaggagccatagtatcttgctacggcaaaaccaaatgcacagcatcaaacaaaaacagaggtattatcaaaaccttctcaaacggatgtgactacgtttcaaacaaaggagtagacacagtatcagtcggaaacaccctatactgtgttaacaaacaagaaggacaatcactgtacgtaaaaggagaacccataataaatttctacgacccacttgtatttccatcagacgaatttgatgcatcaatctcacaagtaaatgaaaaaataaaccaatcattagcattcataagaaaatctgacgagttactacacaacgtaaatgttggcaaatcaacaaccaatataatgataacaacaataataatagtaataatagtcatattactcctcctcatagccgtcggattattcttatactgcaaagcaagataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14661 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut1 (opt11)
  source 1..1931: mol_type = other RNA
gggagaggcgctgcctacggaggtggcagccatctccttctcggcatcaagcttaccatggaactccccatactaaaaaccaacgccatcacaacaatcctcgccgccgtcacactctgcttcgccagctcccaaaacatcaccgaagagttctatcaatcaacctgctccgcagtctcaaagggatacctcggagccctccgcaccggatggtacacttccgtcatcacaatagaactctccaacatcaaagaaaacaaatgcaacggcaccgacgcaaaagtcaagctcatcaaacaagaactcgacaaatataaaaacgccgtcaccgaactccaactactcatgcaatccacacccgcggccggctcaggcagcgccatctgctcaggcatcgccgtctgcaaagtcctccacctcgaaggcgaagtcaacaaaatcaaaaacgcccttctttcaaccaacaaggcagtagtatccctctcaaacggcgtcagcgtcctgaccttcaaagtcctagacctcaaaaactacatagataaacaactcctccccatactgaacaaacaatcgtgctccatccccaatatcgaaaccgtcatagagttccagcagaaaaacaacagacttctcgaaataacccgagagttctcagtaaacgccggagtcaccacacccgtaagcacctacatgctcacaaactcagaactcctatccctcatcaacgacatgcccatcaccaacgaccagaaaaagctaatgtccaacaacgtccaaatagtacgccaacaaagctactcgataatgtgcatcatcaaggaagaagtactcgcctacgtcgtccaactccccctctacggcgtaatcgacacaccctgctggaaactccacacgtccccactctgcacaacaaacacaaaagaaggatccaacatatgcctaacccgcaccgacaggggctggtactgcgacaacgcaggctcagtcagcttctttccccaagccgaaacatgcaaagtccaatccaaccgtgtcttctgcgacaccatgaactcgctcaccctaccctcggaagtcaatctctgcaacatcgacatcttcaacccaaaatacgactgtaaaatcatgaccagcaaaacagacgtttcttccagcgtcatcacatcactcggcgcgatcgtatcatgctatggcaaaacaaagtgcaccgctagcaataaaaaccgaggaatcataaaaaccttcagcaacggctgcgactacgtatccaacaaaggcgtcgacaccgtatccgtcggaaacaccctctactgcgtcaacaagcaagaaggacaatcactctacgtcaaaggcgaaccaatcataaacttctacgacccactcgtattcccctcagacgagttcgacgcatccatctcccaagtcaacgaaaagatcaaccaatctctcgcctttatacgcaaaagcgacgaactccttcacaacgtaaacgtcggcaaaagcaccactaacataatgatcaccacaatcataatagtaatcatcgtaatactcctcctactcatcgccgtgggcctattcctctattgcaaagcccgataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14662 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut1 (opt1)
  source 1..1927: mol_type = other RNA
ggggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14663 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut1 (opt1)
  source 1..1927: mol_type = other RNA
ggggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14664 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut1 (opt2)
  source 1..1927: mol_type = other RNA
ggggcgctgcctacggaggtggcagccatctccttctcggcatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14665 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut1 (opt3)
  source 1..1927: mol_type = other RNA
ggggcgctgcctacggaggtggcagccatctccttctcggcatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14666 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut1 (opt4)
  source 1..1927: mol_type = other RNA
ggggcgctgcctacggaggtggcagccatctccttctcggcatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14667 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut1 (opt5)
  source 1..1927: mol_type = other RNA
ggggcgctgcctacggaggtggcagccatctccttctcggcatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14668 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut1 (opt6)
  source 1..1927: mol_type = other RNA
ggggcgctgcctacggaggtggcagccatctccttctcggcatcaagcttaccatggaattaccaatactaaaaacaaacgcaataacaacaattctagcagcagtaacattatgctttgcatcatcccaaaacatcacagaagaattttatcaatcaacctgctcagcagtttccaaaggatacttaggagcattaagaactggttggtacacttcagtaatcaccatcgaactctcaaacatcaaggaaaacaaatgcaacggaacagacgcaaaagttaaactcataaaacaagaacttgacaaatacaaaaacgccgtaacagaactacaacttctcatgcaatcaacacccgcagcaggatccggatcagccatatgctcaggcatagcagtatgtaaagtattacatcttgaaggtgaagtaaacaaaataaaaaacgcacttctatcaaccaacaaagcagtagtatcactatcaaacggagtatccgtcttaacatttaaagttctagacctcaaaaactatatagacaaacaattactgccaatcctcaataaacaatcatgctcaataccaaacatcgaaacagtaatagaatttcaacaaaaaaacaacagactactagaaataacaagagaattttccgtcaacgccggcgtaactactccagtatcaacatatatgctaaccaactcagaactcctatccctcataaacgacatgccaataactaatgatcaaaaaaaactaatgtcaaacaatgtacaaatagttagacaacaatcatactcaatcatgtgcataataaaagaagaagtactagcatacgtcgtccaactacccctatacggagtaatagacacaccttgctggaaactacacacatcacccctatgcacaacaaatacaaaagaaggttccaacatctgcctaacaagaactgatagaggatggtactgcgacaacgccggatcagtatcattcttccctcaagctgaaacctgcaaagtacaatcaaacagagtattttgcgatacaatgaactccctaacacttccctcagaagttaatctttgtaatatagatatattcaacccaaaatacgactgcaaaataatgacaagtaaaacagacgtatcctcatctgtaattacatcactaggagccatagtatcttgctacggcaaaaccaaatgcacagcatcaaacaaaaacagaggtattatcaaaaccttctcaaacggatgtgactacgtttcaaacaaaggagtagacacagtatcagtcggaaacaccctatactgtgttaacaaacaagaaggacaatcactgtacgtaaaaggagaacccataataaatttctacgacccacttgtatttccatcagacgaatttgatgcatcaatctcacaagtaaatgaaaaaataaaccaatcattagcattcataagaaaatctgacgagttactacacaacgtaaatgttggcaaatcaacaaccaatataatgataacaacaataataatagtaataatagtcatattactcctcctcatagccgtcggattattcttatactgcaaagcaagataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14669 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut1 (opt11)
  source 1..1927: mol_type = other RNA
ggggcgctgcctacggaggtggcagccatctccttctcggcatcaagcttaccatggaactccccatactaaaaaccaacgccatcacaacaatcctcgccgccgtcacactctgcttcgccagctcccaaaacatcaccgaagagttctatcaatcaacctgctccgcagtctcaaagggatacctcggagccctccgcaccggatggtacacttccgtcatcacaatagaactctccaacatcaaagaaaacaaatgcaacggcaccgacgcaaaagtcaagctcatcaaacaagaactcgacaaatataaaaacgccgtcaccgaactccaactactcatgcaatccacacccgcggccggctcaggcagcgccatctgctcaggcatcgccgtctgcaaagtcctccacctcgaaggcgaagtcaacaaaatcaaaaacgcccttctttcaaccaacaaggcagtagtatccctctcaaacggcgtcagcgtcctgaccttcaaagtcctagacctcaaaaactacatagataaacaactcctccccatactgaacaaacaatcgtgctccatccccaatatcgaaaccgtcatagagttccagcagaaaaacaacagacttctcgaaataacccgagagttctcagtaaacgccggagtcaccacacccgtaagcacctacatgctcacaaactcagaactcctatccctcatcaacgacatgcccatcaccaacgaccagaaaaagctaatgtccaacaacgtccaaatagtacgccaacaaagctactcgataatgtgcatcatcaaggaagaagtactcgcctacgtcgtccaactccccctctacggcgtaatcgacacaccctgctggaaactccacacgtccccactctgcacaacaaacacaaaagaaggatccaacatatgcctaacccgcaccgacaggggctggtactgcgacaacgcaggctcagtcagcttctttccccaagccgaaacatgcaaagtccaatccaaccgtgtcttctgcgacaccatgaactcgctcaccctaccctcggaagtcaatctctgcaacatcgacatcttcaacccaaaatacgactgtaaaatcatgaccagcaaaacagacgtttcttccagcgtcatcacatcactcggcgcgatcgtatcatgctatggcaaaacaaagtgcaccgctagcaataaaaaccgaggaatcataaaaaccttcagcaacggctgcgactacgtatccaacaaaggcgtcgacaccgtatccgtcggaaacaccctctactgcgtcaacaagcaagaaggacaatcactctacgtcaaaggcgaaccaatcataaacttctacgacccactcgtattcccctcagacgagttcgacgcatccatctcccaagtcaacgaaaagatcaaccaatctctcgcctttatacgcaaaagcgacgaactccttcacaacgtaaacgtcggcaaaagcaccactaacataatgatcaccacaatcataatagtaatcatcgtaatactcctcctactcatcgccgtgggcctattcctctattgcaaagcccgataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14670 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut1 (opt1)
  source 1..1762: mol_type = other RNA
gggagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14671 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut1 (opt1)
  source 1..1762: mol_type = other RNA
gggagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14672 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut1 (opt2)
  source 1..1762: mol_type = other RNA
gggagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14673 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut1 (opt3)
  source 1..1762: mol_type = other RNA
gggagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctactcctgccgctggctcggggtcagcaatatgtagcggaatcgccgtgtgcaaggtcttgcacctcgagggcgaagtgaacaaaattaagaatgctctgctgagtaccaacaaagccgttgtgtccctctctaatggtgtcagcgtgttaacgttcaaggtactggaccttaagaactacatcgataaacaattgctgccaattctaaataagcagtcctgttcaatcccgaacatagagactgttattgaatttcagcagaaaaataacaggctcctggagatcacccgggagttcagtgtgaatgcgggggtcacaactcccgtgagcacctatatgcttacaaactctgaactgttgtccctcattaacgacatgcctatcaccaatgatcaaaagaaactgatgtcaaacaatgtgcagatcgtccgccagcagagctacagtattatgtgcataatcaaggaggaagttttagcatatgtggtacaactgccactctacggagtgattgacacgccctgttggaaacttcatacttctcctctgtgcacaaccaacactaaggagggctccaatatctgtttgacacgaaccgatcgtggctggtactgcgacaacgccgggagcgtctcgtttttcccacaggctgaaacgtgtaaggtgcagtctaatagagtgttttgcgataccatgaactccctaacactgccctcagaggttaatctctgcaacatagacattttcaatcctaaatatgattgtaagatcatgacaagtaaaaccgacgtcagctcctctgtgatcacaagcctgggagccattgtatcatgctacggtaagactaaatgtaccgcaagtaacaagaataggggcatcattaagacattttccaacgggtgcgattatgttagcaataaaggagtggacaccgtctctgtgggcaacactctttactgtgtcaacaagcaagagggtcagtcactgtatgtgaaaggggaaccaataatcaatttctacgacccgttggtttttcccagtgatgagttcgacgctagcatttcccaggtgaacgaaaagatcaatcagtctctcgcctttatccggaaatcggatgagctgttacacaacgtaaatgtcggaaagagcacgacaaacattatgataaccactatcattatcgtgattatcgttatactgctactcctgatcgcggtgggccttttcttgtattgcaaggcccgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14674 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut1 (opt4)
  source 1..1762: mol_type = other RNA
gggagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14675 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut1 (opt5)
  source 1..1762: mol_type = other RNA
gggagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccctgccgctgggtctggaagcgccatttgttccggcatcgcggtctgcaaggtgctccacctggagggggaagttaacaaaattaagaatgcccttctgagcacaaacaaagctgtggtctctctctccaatggagtgagcgttctgaccttcaaggtgcttgacctgaagaactacatcgataaacaactcctgccgattctgaataagcagtcttgttccatccccaacattgagacagtcatcgaatttcagcagaaaaataaccggctcctggagatcacccgcgagttcagcgtgaatgccggcgtgacgacacctgtctctacctatatgcttacaaactccgaactgctcagcctgattaacgacatgcccatcaccaatgatcaaaagaaacttatgtccaacaatgttcagattgtgagacagcagtcttacagcatcatgtgcattatcaaggaggaagtgctggcttatgtcgtgcaactccctctgtacggcgttatcgacaccccctgttggaaactgcatacatcccctctctgcacgaccaacacaaaggaggggagcaatatttgtctgacccggacagatcgcggatggtactgcgacaacgccggctctgtgtcctttttcccgcaggcggaaacctgtaaggtccagagcaatagagtgttttgcgatacgatgaactctcttacactgcccagcgaggttaatctctgcaacatcgacattttcaatcctaaatatgattgtaagatcatgacctccaaaaccgacgtgtctagctccgtcattacaagcctgggggccatcgtgtcttgctacggaaagaccaaatgtacagcttccaacaagaatcggggcatcattaagacgtttagcaacgggtgcgattatgtctctaataaaggagtggacaccgtttccgtgggcaacacactttactgtgtcaacaagcaagagggccagagcctgtatgtgaaaggggaacccatcattaatttctacgaccctctcgtttttccctccgatgagttcgacgcctctatcagccaggtgaacgaaaagattaatcagtccctggcttttatccgcaaatctgatgagctgctccacaacgtcaatgtgggaaagagcaccacaaacattatgatcaccacgatcattatcgtgattatcgttattctgcttctgctcatcgccgtcggcctgttcctgtattgcaaggccagatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14676 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut1 (opt6)
  source 1..1762: mol_type = other RNA
gggagaaagcttaccatggaattaccaatactaaaaacaaacgcaataacaacaattctagcagcagtaacattatgctttgcatcatcccaaaacatcacagaagaattttatcaatcaacctgctcagcagtttccaaaggatacttaggagcattaagaactggttggtacacttcagtaatcaccatcgaactctcaaacatcaaggaaaacaaatgcaacggaacagacgcaaaagttaaactcataaaacaagaacttgacaaatacaaaaacgccgtaacagaactacaacttctcatgcaatcaacacccgcagcaggatccggatcagccatatgctcaggcatagcagtatgtaaagtattacatcttgaaggtgaagtaaacaaaataaaaaacgcacttctatcaaccaacaaagcagtagtatcactatcaaacggagtatccgtcttaacatttaaagttctagacctcaaaaactatatagacaaacaattactgccaatcctcaataaacaatcatgctcaataccaaacatcgaaacagtaatagaatttcaacaaaaaaacaacagactactagaaataacaagagaattttccgtcaacgccggcgtaactactccagtatcaacatatatgctaaccaactcagaactcctatccctcataaacgacatgccaataactaatgatcaaaaaaaactaatgtcaaacaatgtacaaatagttagacaacaatcatactcaatcatgtgcataataaaagaagaagtactagcatacgtcgtccaactacccctatacggagtaatagacacaccttgctggaaactacacacatcacccctatgcacaacaaatacaaaagaaggttccaacatctgcctaacaagaactgatagaggatggtactgcgacaacgccggatcagtatcattcttccctcaagctgaaacctgcaaagtacaatcaaacagagtattttgcgatacaatgaactccctaacacttccctcagaagttaatctttgtaatatagatatattcaacccaaaatacgactgcaaaataatgacaagtaaaacagacgtatcctcatctgtaattacatcactaggagccatagtatcttgctacggcaaaaccaaatgcacagcatcaaacaaaaacagaggtattatcaaaaccttctcaaacggatgtgactacgtttcaaacaaaggagtagacacagtatcagtcggaaacaccctatactgtgttaacaaacaagaaggacaatcactgtacgtaaaaggagaacccataataaatttctacgacccacttgtatttccatcagacgaatttgatgcatcaatctcacaagtaaatgaaaaaataaaccaatcattagcattcataagaaaatctgacgagttactacacaacgtaaatgttggcaaatcaacaaccaatataatgataacaacaataataatagtaataatagtcatattactcctcctcatagccgtcggattattcttatactgcaaagcaagataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14677 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut1 (opt11)
  source 1..1762: mol_type = other RNA
gggagaaagcttaccatggaactccccatactaaaaaccaacgccatcacaacaatcctcgccgccgtcacactctgcttcgccagctcccaaaacatcaccgaagagttctatcaatcaacctgctccgcagtctcaaagggatacctcggagccctccgcaccggatggtacacttccgtcatcacaatagaactctccaacatcaaagaaaacaaatgcaacggcaccgacgcaaaagtcaagctcatcaaacaagaactcgacaaatataaaaacgccgtcaccgaactccaactactcatgcaatccacacccgcggccggctcaggcagcgccatctgctcaggcatcgccgtctgcaaagtcctccacctcgaaggcgaagtcaacaaaatcaaaaacgcccttctttcaaccaacaaggcagtagtatccctctcaaacggcgtcagcgtcctgaccttcaaagtcctagacctcaaaaactacatagataaacaactcctccccatactgaacaaacaatcgtgctccatccccaatatcgaaaccgtcatagagttccagcagaaaaacaacagacttctcgaaataacccgagagttctcagtaaacgccggagtcaccacacccgtaagcacctacatgctcacaaactcagaactcctatccctcatcaacgacatgcccatcaccaacgaccagaaaaagctaatgtccaacaacgtccaaatagtacgccaacaaagctactcgataatgtgcatcatcaaggaagaagtactcgcctacgtcgtccaactccccctctacggcgtaatcgacacaccctgctggaaactccacacgtccccactctgcacaacaaacacaaaagaaggatccaacatatgcctaacccgcaccgacaggggctggtactgcgacaacgcaggctcagtcagcttctttccccaagccgaaacatgcaaagtccaatccaaccgtgtcttctgcgacaccatgaactcgctcaccctaccctcggaagtcaatctctgcaacatcgacatcttcaacccaaaatacgactgtaaaatcatgaccagcaaaacagacgtttcttccagcgtcatcacatcactcggcgcgatcgtatcatgctatggcaaaacaaagtgcaccgctagcaataaaaaccgaggaatcataaaaaccttcagcaacggctgcgactacgtatccaacaaaggcgtcgacaccgtatccgtcggaaacaccctctactgcgtcaacaagcaagaaggacaatcactctacgtcaaaggcgaaccaatcataaacttctacgacccactcgtattcccctcagacgagttcgacgcatccatctcccaagtcaacgaaaagatcaaccaatctctcgcctttatacgcaaaagcgacgaactccttcacaacgtaaacgtcggcaaaagcaccactaacataatgatcaccacaatcataatagtaatcatcgtaatactcctcctactcatcgccgtgggcctattcctctattgcaaagcccgataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14678 - protein, 535 aa, synthetic construct
  REGION 1..535: note = derived and/or modified protein sequence (artificial) from HRSV(Memphis-37)__AIY60640.1__F_DSCav1_mut2
MELPILKTNAITTILAAVTLCFASSQNITEEFYQSTCSAVSKGYLGALRTGWYTSVITIELSNIKENKCNGTDAKVKLIKQELDKYKNAVTDLQLLMQSTPAAGSGSAICSGIAVCKVLHLEGEVNKIKNALLSTNKAVVSLSNGVSVLTFKVLDLKNYIDKQLLPILNKQSCSIPNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYCVNKQEGQSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 14679 - RNA, 1608 nt, synthetic construct
  misc_feature 1..1608: note = derived and/or modified CDS sequence (opt1) from HRSV(Memphis-37)__AIY60640.1__F_DSCav1_mut2
  source 1..1608: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactga

SEQ ID NO: 14680 - RNA, 1608 nt, synthetic construct
  misc_feature 1..1608: note = derived and/or modified CDS sequence (opt1) from HRSV(Memphis-37)__AIY60640.1__F_DSCav1_mut2
  source 1..1608: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactga

SEQ ID NO: 14681 - RNA, 1608 nt, synthetic construct
  misc_feature 1..1608: note = derived and/or modified CDS sequence (opt2) from HRSV(Memphis-37)__AIY60640.1__F_DSCav1_mut2
  source 1..1608: mol_type = other RNA
atggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactga

SEQ ID NO: 14682 - RNA, 1608 nt, synthetic construct
  misc_feature 1..1608: note = derived and/or modified CDS sequence (opt3) from HRSV(Memphis-37)__AIY60640.1__F_DSCav1_mut2
  source 1..1608: mol_type = other RNA
atggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagatcaactcagtggcattaataacatcgcattctctaattga

SEQ ID NO: 14683 - RNA, 1608 nt, synthetic construct
  misc_feature 1..1608: note = derived and/or modified CDS sequence (opt4) from HRSV(Memphis-37)__AIY60640.1__F_DSCav1_mut2
  source 1..1608: mol_type = other RNA
atggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactga

SEQ ID NO: 14684 - RNA, 1608 nt, synthetic construct
  misc_feature 1..1608: note = derived and/or modified CDS sequence (opt5) from HRSV(Memphis-37)__AIY60640.1__F_DSCav1_mut2
  source 1..1608: mol_type = other RNA
atggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagatcaactctctgggatcaataacattgctttctccaattga

SEQ ID NO: 14685 - RNA, 1608 nt, synthetic construct
  misc_feature 1..1608: note = derived and/or modified CDS sequence (opt6) from HRSV(Memphis-37)__AIY60640.1__F_DSCav1_mut2
  source 1..1608: mol_type = other RNA
atggagcttccaatattaaaaacaaacgctataacaactatactcgcagcagttacactctgcttcgcatcctcacaaaacataactgaagaattttaccaatccacttgctcagccgtatcaaaaggatatctaggagcacttagaaccggatggtatacatcagtgataacaatagaactaagcaacataaaagaaaacaagtgcaacggaactgacgcaaaagtcaaactaatcaaacaagaactagacaaatacaaaaacgcagtaacagacctacaattactaatgcaatcaacaccagcagcaggatcaggttcagccatatgctcaggtatcgctgtatgcaaagtccttcacctagaaggtgaagtaaacaaaattaaaaacgccctactcagtacaaataaagctgtcgtaagtttatcaaacggagtatcagtccttacattcaaagtattagacctaaaaaattatatagacaaacaattactaccaatactcaacaaacaatcatgctcaataccaaatatagaaaccgtaatagaatttcagcaaaaaaataacagattactagaaataaccagagaattttcagtcaacgcaggagtcacaacacccgtctcaacctacatgctaaccaactcagaacttctatctcttatcaacgacatgcccataaccaatgatcaaaaaaaattaatgtctaataacgttcaaatagtaagacaacaatcatactcaataatgtgcataatcaaagaagaagtattagcatacgtagtacaactacccctatatggagtaatagacacaccctgctggaaactacacacatcccccctctgtacaacaaacactaaagaaggatcaaacatttgcctaacaagaacagaccgcggatggtactgcgacaacgcaggctccgtatctttctttccacaagccgaaacttgtaaagttcaatcaaacagagtattttgcgatacaatgaactccttaacattaccttcagaagtaaacctatgcaacatagacatcttcaacccaaaatacgactgcaaaataatgacctcaaaaacagacgtatcctcatcagtcataacctccttaggagcaatagtatcatgttacggaaaaacaaaatgtacagcatcaaataaaaatagaggaataataaaaaccttctccaacggatgcgactacgtatccaataaaggagtagacaccgtatcagtaggaaacacactatactgtgtaaacaaacaagaaggccaatctctatatgtaaaaggcgaaccaatcataaatttttacgacccacttgtcttcccctccgacgaatttgacgcaagcatatcacaagtaaacgaaaaaatcaaccaaagcctagccttcataaggaaatctgacgaattacttcataacgtaaatgttggaaaatcaaccacaaacataatgataaccaccatcataattgtaataatagtaatactactactactaattgcagtaggactcttcctatattgcaaagctcgctcaacaccagttaccttatcaaaagaccaactatctggaataaacaacatagccttttccaactaa

SEQ ID NO: 14686 - RNA, 1608 nt, synthetic construct
  misc_feature 1..1608: note = derived and/or modified CDS sequence (opt11) from HRSV(Memphis-37)__AIY60640.1__F_DSCav1_mut2
  source 1..1608: mol_type = other RNA
atggaactcccaatcctaaaaaccaacgccatcaccaccatcctcgccgctgtcaccttatgctttgccagcagccaaaacatcaccgaagaattttaccaatcaacatgctccgccgtctcaaaaggatacctcggcgccctacgcaccggctggtacacaagcgtcataaccatcgagctctccaacatcaaggaaaacaaatgcaatggaaccgacgccaaagtcaaactaatcaaacaagaactagacaagtacaagaacgcagtcaccgacctccaactcctcatgcagtccacccccgcagcaggctctggctcagcaatatgctccggcatcgctgtctgcaaagtcctacacctcgaaggcgaagtcaacaaaatcaaaaacgccctactgtccacaaacaaagccgtcgtctccctatccaacggcgtctcggtcctaacctttaaggttctcgatctcaaaaattacatagacaaacaactactccccatcctcaacaaacaatcttgctcaatccccaacatcgaaaccgtcatcgagttccaacagaaaaacaacagactactcgaaatcacccgcgagttctcagtcaacgcgggcgtcacaacacccgtcagcacctacatgctaaccaactccgaactcctcagcctcattaacgacatgcccatcaccaacgaccaaaagaaacttatgtccaacaacgttcaaatcgtccgccaacaatcctactccatcatgtgcatcatcaaagaagaagtactcgcctacgtagtccaactgcccctctacggcgtcatcgataccccatgctggaaactacacaccagccccctctgcaccaccaacaccaaagaaggctccaatatctgcttaacccgcacagaccgtggctggtactgcgataacgccggctccgtctccttcttcccccaagcagaaacctgcaaagtacaatccaaccgagtcttctgtgacaccatgaactccctaacccttccatcagaagtcaacctctgcaacatcgacatcttcaaccccaagtacgactgcaaaatcatgacatccaaaaccgatgtctcaagcagcgtcataacctcactcggcgctatcgtaagctgctacggcaaaaccaaatgcaccgcatcaaacaaaaaccgcggaatcatcaaaaccttcagcaacggatgcgactacgtttccaacaaaggcgtagacaccgtctccgtcggaaacaccctctactgcgtaaacaaacaggaaggccaatccctctacgtcaaaggcgaacccatcataaacttctacgatccccttgtcttcccgtccgatgagttcgacgcctccatctcgcaagtcaacgaaaagataaaccaatcactagcattcatccgtaaatccgacgaactcctccacaacgtcaacgtcggaaaatccaccaccaacataatgatcaccaccataatcatcgtcatcatcgtaatactattactcctcatagccgtcggcctcttcctatattgcaaagcccgatcaacccccgtaaccctttctaaagaccaactgtccggaatcaacaacatcgctttcagcaactga

SEQ ID NO: 14687 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut2 (opt1)
  source 1..1884: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14688 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut2 (opt1)
  source 1..1884: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14689 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut2 (opt2)
  source 1..1884: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14690 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut2 (opt3)
  source 1..1884: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagatcaactcagtggcattaataacatcgcattctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14691 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut2 (opt4)
  source 1..1884: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14692 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut2 (opt5)
  source 1..1884: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagatcaactctctgggatcaataacattgctttctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14693 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut2 (opt6)
  source 1..1884: mol_type = other RNA
gggagagtcccgcagtcggcgtccagcggctctgcttgttcgtgtgtgtgtcgttgcaggccttattcaagcttaccatggagcttccaatattaaaaacaaacgctataacaactatactcgcagcagttacactctgcttcgcatcctcacaaaacataactgaagaattttaccaatccacttgctcagccgtatcaaaaggatatctaggagcacttagaaccggatggtatacatcagtgataacaatagaactaagcaacataaaagaaaacaagtgcaacggaactgacgcaaaagtcaaactaatcaaacaagaactagacaaatacaaaaacgcagtaacagacctacaattactaatgcaatcaacaccagcagcaggatcaggttcagccatatgctcaggtatcgctgtatgcaaagtccttcacctagaaggtgaagtaaacaaaattaaaaacgccctactcagtacaaataaagctgtcgtaagtttatcaaacggagtatcagtccttacattcaaagtattagacctaaaaaattatatagacaaacaattactaccaatactcaacaaacaatcatgctcaataccaaatatagaaaccgtaatagaatttcagcaaaaaaataacagattactagaaataaccagagaattttcagtcaacgcaggagtcacaacacccgtctcaacctacatgctaaccaactcagaacttctatctcttatcaacgacatgcccataaccaatgatcaaaaaaaattaatgtctaataacgttcaaatagtaagacaacaatcatactcaataatgtgcataatcaaagaagaagtattagcatacgtagtacaactacccctatatggagtaatagacacaccctgctggaaactacacacatcccccctctgtacaacaaacactaaagaaggatcaaacatttgcctaacaagaacagaccgcggatggtactgcgacaacgcaggctccgtatctttctttccacaagccgaaacttgtaaagttcaatcaaacagagtattttgcgatacaatgaactccttaacattaccttcagaagtaaacctatgcaacatagacatcttcaacccaaaatacgactgcaaaataatgacctcaaaaacagacgtatcctcatcagtcataacctccttaggagcaatagtatcatgttacggaaaaacaaaatgtacagcatcaaataaaaatagaggaataataaaaaccttctccaacggatgcgactacgtatccaataaaggagtagacaccgtatcagtaggaaacacactatactgtgtaaacaaacaagaaggccaatctctatatgtaaaaggcgaaccaatcataaatttttacgacccacttgtcttcccctccgacgaatttgacgcaagcatatcacaagtaaacgaaaaaatcaaccaaagcctagccttcataaggaaatctgacgaattacttcataacgtaaatgttggaaaatcaaccacaaacataatgataaccaccatcataattgtaataatagtaatactactactactaattgcagtaggactcttcctatattgcaaagctcgctcaacaccagttaccttatcaaaagaccaactatctggaataaacaacatagccttttccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14694 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut2 (opt11)
  source 1..1884: mol_type = other RNA
gggagagtcccgcagtcggcgtccagcggctctgcttgttcgtgtgtgtgtcgttgcaggccttattcaagcttaccatggaactcccaatcctaaaaaccaacgccatcaccaccatcctcgccgctgtcaccttatgctttgccagcagccaaaacatcaccgaagaattttaccaatcaacatgctccgccgtctcaaaaggatacctcggcgccctacgcaccggctggtacacaagcgtcataaccatcgagctctccaacatcaaggaaaacaaatgcaatggaaccgacgccaaagtcaaactaatcaaacaagaactagacaagtacaagaacgcagtcaccgacctccaactcctcatgcagtccacccccgcagcaggctctggctcagcaatatgctccggcatcgctgtctgcaaagtcctacacctcgaaggcgaagtcaacaaaatcaaaaacgccctactgtccacaaacaaagccgtcgtctccctatccaacggcgtctcggtcctaacctttaaggttctcgatctcaaaaattacatagacaaacaactactccccatcctcaacaaacaatcttgctcaatccccaacatcgaaaccgtcatcgagttccaacagaaaaacaacagactactcgaaatcacccgcgagttctcagtcaacgcgggcgtcacaacacccgtcagcacctacatgctaaccaactccgaactcctcagcctcattaacgacatgcccatcaccaacgaccaaaagaaacttatgtccaacaacgttcaaatcgtccgccaacaatcctactccatcatgtgcatcatcaaagaagaagtactcgcctacgtagtccaactgcccctctacggcgtcatcgataccccatgctggaaactacacaccagccccctctgcaccaccaacaccaaagaaggctccaatatctgcttaacccgcacagaccgtggctggtactgcgataacgccggctccgtctccttcttcccccaagcagaaacctgcaaagtacaatccaaccgagtcttctgtgacaccatgaactccctaacccttccatcagaagtcaacctctgcaacatcgacatcttcaaccccaagtacgactgcaaaatcatgacatccaaaaccgatgtctcaagcagcgtcataacctcactcggcgctatcgtaagctgctacggcaaaaccaaatgcaccgcatcaaacaaaaaccgcggaatcatcaaaaccttcagcaacggatgcgactacgtttccaacaaaggcgtagacaccgtctccgtcggaaacaccctctactgcgtaaacaaacaggaaggccaatccctctacgtcaaaggcgaacccatcataaacttctacgatccccttgtcttcccgtccgatgagttcgacgcctccatctcgcaagtcaacgaaaagataaaccaatcactagcattcatccgtaaatccgacgaactcctccacaacgtcaacgtcggaaaatccaccaccaacataatgatcaccaccataatcatcgtcatcatcgtaatactattactcctcatagccgtcggcctcttcctatattgcaaagcccgatcaacccccgtaaccctttctaaagaccaactgtccggaatcaacaacatcgctttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14695 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut2 (opt1)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14696 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut2 (opt1)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14697 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut2 (opt2)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14698 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut2 (opt3)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagatcaactcagtggcattaataacatcgcattctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14699 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut2 (opt4)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14700 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut2 (opt5)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagatcaactctctgggatcaataacattgctttctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14701 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut2 (opt6)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagcttccaatattaaaaacaaacgctataacaactatactcgcagcagttacactctgcttcgcatcctcacaaaacataactgaagaattttaccaatccacttgctcagccgtatcaaaaggatatctaggagcacttagaaccggatggtatacatcagtgataacaatagaactaagcaacataaaagaaaacaagtgcaacggaactgacgcaaaagtcaaactaatcaaacaagaactagacaaatacaaaaacgcagtaacagacctacaattactaatgcaatcaacaccagcagcaggatcaggttcagccatatgctcaggtatcgctgtatgcaaagtccttcacctagaaggtgaagtaaacaaaattaaaaacgccctactcagtacaaataaagctgtcgtaagtttatcaaacggagtatcagtccttacattcaaagtattagacctaaaaaattatatagacaaacaattactaccaatactcaacaaacaatcatgctcaataccaaatatagaaaccgtaatagaatttcagcaaaaaaataacagattactagaaataaccagagaattttcagtcaacgcaggagtcacaacacccgtctcaacctacatgctaaccaactcagaacttctatctcttatcaacgacatgcccataaccaatgatcaaaaaaaattaatgtctaataacgttcaaatagtaagacaacaatcatactcaataatgtgcataatcaaagaagaagtattagcatacgtagtacaactacccctatatggagtaatagacacaccctgctggaaactacacacatcccccctctgtacaacaaacactaaagaaggatcaaacatttgcctaacaagaacagaccgcggatggtactgcgacaacgcaggctccgtatctttctttccacaagccgaaacttgtaaagttcaatcaaacagagtattttgcgatacaatgaactccttaacattaccttcagaagtaaacctatgcaacatagacatcttcaacccaaaatacgactgcaaaataatgacctcaaaaacagacgtatcctcatcagtcataacctccttaggagcaatagtatcatgttacggaaaaacaaaatgtacagcatcaaataaaaatagaggaataataaaaaccttctccaacggatgcgactacgtatccaataaaggagtagacaccgtatcagtaggaaacacactatactgtgtaaacaaacaagaaggccaatctctatatgtaaaaggcgaaccaatcataaatttttacgacccacttgtcttcccctccgacgaatttgacgcaagcatatcacaagtaaacgaaaaaatcaaccaaagcctagccttcataaggaaatctgacgaattacttcataacgtaaatgttggaaaatcaaccacaaacataatgataaccaccatcataattgtaataatagtaatactactactactaattgcagtaggactcttcctatattgcaaagctcgctcaacaccagttaccttatcaaaagaccaactatctggaataaacaacatagccttttccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14702 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut2 (opt11)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggaactcccaatcctaaaaaccaacgccatcaccaccatcctcgccgctgtcaccttatgctttgccagcagccaaaacatcaccgaagaattttaccaatcaacatgctccgccgtctcaaaaggatacctcggcgccctacgcaccggctggtacacaagcgtcataaccatcgagctctccaacatcaaggaaaacaaatgcaatggaaccgacgccaaagtcaaactaatcaaacaagaactagacaagtacaagaacgcagtcaccgacctccaactcctcatgcagtccacccccgcagcaggctctggctcagcaatatgctccggcatcgctgtctgcaaagtcctacacctcgaaggcgaagtcaacaaaatcaaaaacgccctactgtccacaaacaaagccgtcgtctccctatccaacggcgtctcggtcctaacctttaaggttctcgatctcaaaaattacatagacaaacaactactccccatcctcaacaaacaatcttgctcaatccccaacatcgaaaccgtcatcgagttccaacagaaaaacaacagactactcgaaatcacccgcgagttctcagtcaacgcgggcgtcacaacacccgtcagcacctacatgctaaccaactccgaactcctcagcctcattaacgacatgcccatcaccaacgaccaaaagaaacttatgtccaacaacgttcaaatcgtccgccaacaatcctactccatcatgtgcatcatcaaagaagaagtactcgcctacgtagtccaactgcccctctacggcgtcatcgataccccatgctggaaactacacaccagccccctctgcaccaccaacaccaaagaaggctccaatatctgcttaacccgcacagaccgtggctggtactgcgataacgccggctccgtctccttcttcccccaagcagaaacctgcaaagtacaatccaaccgagtcttctgtgacaccatgaactccctaacccttccatcagaagtcaacctctgcaacatcgacatcttcaaccccaagtacgactgcaaaatcatgacatccaaaaccgatgtctcaagcagcgtcataacctcactcggcgctatcgtaagctgctacggcaaaaccaaatgcaccgcatcaaacaaaaaccgcggaatcatcaaaaccttcagcaacggatgcgactacgtttccaacaaaggcgtagacaccgtctccgtcggaaacaccctctactgcgtaaacaaacaggaaggccaatccctctacgtcaaaggcgaacccatcataaacttctacgatccccttgtcttcccgtccgatgagttcgacgcctccatctcgcaagtcaacgaaaagataaaccaatcactagcattcatccgtaaatccgacgaactcctccacaacgtcaacgtcggaaaatccaccaccaacataatgatcaccaccataatcatcgtcatcatcgtaatactattactcctcatagccgtcggcctcttcctatattgcaaagcccgatcaacccccgtaaccctttctaaagaccaactgtccggaatcaacaacatcgctttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14703 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut2 (opt1)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14704 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut2 (opt1)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14705 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut2 (opt2)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14706 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut2 (opt3)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagatcaactcagtggcattaataacatcgcattctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14707 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut2 (opt4)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14708 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut2 (opt5)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagatcaactctctgggatcaataacattgctttctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14709 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut2 (opt6)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagcttccaatattaaaaacaaacgctataacaactatactcgcagcagttacactctgcttcgcatcctcacaaaacataactgaagaattttaccaatccacttgctcagccgtatcaaaaggatatctaggagcacttagaaccggatggtatacatcagtgataacaatagaactaagcaacataaaagaaaacaagtgcaacggaactgacgcaaaagtcaaactaatcaaacaagaactagacaaatacaaaaacgcagtaacagacctacaattactaatgcaatcaacaccagcagcaggatcaggttcagccatatgctcaggtatcgctgtatgcaaagtccttcacctagaaggtgaagtaaacaaaattaaaaacgccctactcagtacaaataaagctgtcgtaagtttatcaaacggagtatcagtccttacattcaaagtattagacctaaaaaattatatagacaaacaattactaccaatactcaacaaacaatcatgctcaataccaaatatagaaaccgtaatagaatttcagcaaaaaaataacagattactagaaataaccagagaattttcagtcaacgcaggagtcacaacacccgtctcaacctacatgctaaccaactcagaacttctatctcttatcaacgacatgcccataaccaatgatcaaaaaaaattaatgtctaataacgttcaaatagtaagacaacaatcatactcaataatgtgcataatcaaagaagaagtattagcatacgtagtacaactacccctatatggagtaatagacacaccctgctggaaactacacacatcccccctctgtacaacaaacactaaagaaggatcaaacatttgcctaacaagaacagaccgcggatggtactgcgacaacgcaggctccgtatctttctttccacaagccgaaacttgtaaagttcaatcaaacagagtattttgcgatacaatgaactccttaacattaccttcagaagtaaacctatgcaacatagacatcttcaacccaaaatacgactgcaaaataatgacctcaaaaacagacgtatcctcatcagtcataacctccttaggagcaatagtatcatgttacggaaaaacaaaatgtacagcatcaaataaaaatagaggaataataaaaaccttctccaacggatgcgactacgtatccaataaaggagtagacaccgtatcagtaggaaacacactatactgtgtaaacaaacaagaaggccaatctctatatgtaaaaggcgaaccaatcataaatttttacgacccacttgtcttcccctccgacgaatttgacgcaagcatatcacaagtaaacgaaaaaatcaaccaaagcctagccttcataaggaaatctgacgaattacttcataacgtaaatgttggaaaatcaaccacaaacataatgataaccaccatcataattgtaataatagtaatactactactactaattgcagtaggactcttcctatattgcaaagctcgctcaacaccagttaccttatcaaaagaccaactatctggaataaacaacatagccttttccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14710 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut2 (opt11)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccaatcctaaaaaccaacgccatcaccaccatcctcgccgctgtcaccttatgctttgccagcagccaaaacatcaccgaagaattttaccaatcaacatgctccgccgtctcaaaaggatacctcggcgccctacgcaccggctggtacacaagcgtcataaccatcgagctctccaacatcaaggaaaacaaatgcaatggaaccgacgccaaagtcaaactaatcaaacaagaactagacaagtacaagaacgcagtcaccgacctccaactcctcatgcagtccacccccgcagcaggctctggctcagcaatatgctccggcatcgctgtctgcaaagtcctacacctcgaaggcgaagtcaacaaaatcaaaaacgccctactgtccacaaacaaagccgtcgtctccctatccaacggcgtctcggtcctaacctttaaggttctcgatctcaaaaattacatagacaaacaactactccccatcctcaacaaacaatcttgctcaatccccaacatcgaaaccgtcatcgagttccaacagaaaaacaacagactactcgaaatcacccgcgagttctcagtcaacgcgggcgtcacaacacccgtcagcacctacatgctaaccaactccgaactcctcagcctcattaacgacatgcccatcaccaacgaccaaaagaaacttatgtccaacaacgttcaaatcgtccgccaacaatcctactccatcatgtgcatcatcaaagaagaagtactcgcctacgtagtccaactgcccctctacggcgtcatcgataccccatgctggaaactacacaccagccccctctgcaccaccaacaccaaagaaggctccaatatctgcttaacccgcacagaccgtggctggtactgcgataacgccggctccgtctccttcttcccccaagcagaaacctgcaaagtacaatccaaccgagtcttctgtgacaccatgaactccctaacccttccatcagaagtcaacctctgcaacatcgacatcttcaaccccaagtacgactgcaaaatcatgacatccaaaaccgatgtctcaagcagcgtcataacctcactcggcgctatcgtaagctgctacggcaaaaccaaatgcaccgcatcaaacaaaaaccgcggaatcatcaaaaccttcagcaacggatgcgactacgtttccaacaaaggcgtagacaccgtctccgtcggaaacaccctctactgcgtaaacaaacaggaaggccaatccctctacgtcaaaggcgaacccatcataaacttctacgatccccttgtcttcccgtccgatgagttcgacgcctccatctcgcaagtcaacgaaaagataaaccaatcactagcattcatccgtaaatccgacgaactcctccacaacgtcaacgtcggaaaatccaccaccaacataatgatcaccaccataatcatcgtcatcatcgtaatactattactcctcatagccgtcggcctcttcctatattgcaaagcccgatcaacccccgtaaccctttctaaagaccaactgtccggaatcaacaacatcgctttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14711 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut2 (opt1)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14712 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut2 (opt1)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14713 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut2 (opt2)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14714 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut2 (opt3)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagatcaactcagtggcattaataacatcgcattctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14715 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut2 (opt4)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14716 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut2 (opt5)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagatcaactctctgggatcaataacattgctttctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14717 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut2 (opt6)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagcttccaatattaaaaacaaacgctataacaactatactcgcagcagttacactctgcttcgcatcctcacaaaacataactgaagaattttaccaatccacttgctcagccgtatcaaaaggatatctaggagcacttagaaccggatggtatacatcagtgataacaatagaactaagcaacataaaagaaaacaagtgcaacggaactgacgcaaaagtcaaactaatcaaacaagaactagacaaatacaaaaacgcagtaacagacctacaattactaatgcaatcaacaccagcagcaggatcaggttcagccatatgctcaggtatcgctgtatgcaaagtccttcacctagaaggtgaagtaaacaaaattaaaaacgccctactcagtacaaataaagctgtcgtaagtttatcaaacggagtatcagtccttacattcaaagtattagacctaaaaaattatatagacaaacaattactaccaatactcaacaaacaatcatgctcaataccaaatatagaaaccgtaatagaatttcagcaaaaaaataacagattactagaaataaccagagaattttcagtcaacgcaggagtcacaacacccgtctcaacctacatgctaaccaactcagaacttctatctcttatcaacgacatgcccataaccaatgatcaaaaaaaattaatgtctaataacgttcaaatagtaagacaacaatcatactcaataatgtgcataatcaaagaagaagtattagcatacgtagtacaactacccctatatggagtaatagacacaccctgctggaaactacacacatcccccctctgtacaacaaacactaaagaaggatcaaacatttgcctaacaagaacagaccgcggatggtactgcgacaacgcaggctccgtatctttctttccacaagccgaaacttgtaaagttcaatcaaacagagtattttgcgatacaatgaactccttaacattaccttcagaagtaaacctatgcaacatagacatcttcaacccaaaatacgactgcaaaataatgacctcaaaaacagacgtatcctcatcagtcataacctccttaggagcaatagtatcatgttacggaaaaacaaaatgtacagcatcaaataaaaatagaggaataataaaaaccttctccaacggatgcgactacgtatccaataaaggagtagacaccgtatcagtaggaaacacactatactgtgtaaacaaacaagaaggccaatctctatatgtaaaaggcgaaccaatcataaatttttacgacccacttgtcttcccctccgacgaatttgacgcaagcatatcacaagtaaacgaaaaaatcaaccaaagcctagccttcataaggaaatctgacgaattacttcataacgtaaatgttggaaaatcaaccacaaacataatgataaccaccatcataattgtaataatagtaatactactactactaattgcagtaggactcttcctatattgcaaagctcgctcaacaccagttaccttatcaaaagaccaactatctggaataaacaacatagccttttccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14718 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut2 (opt11)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcccaatcctaaaaaccaacgccatcaccaccatcctcgccgctgtcaccttatgctttgccagcagccaaaacatcaccgaagaattttaccaatcaacatgctccgccgtctcaaaaggatacctcggcgccctacgcaccggctggtacacaagcgtcataaccatcgagctctccaacatcaaggaaaacaaatgcaatggaaccgacgccaaagtcaaactaatcaaacaagaactagacaagtacaagaacgcagtcaccgacctccaactcctcatgcagtccacccccgcagcaggctctggctcagcaatatgctccggcatcgctgtctgcaaagtcctacacctcgaaggcgaagtcaacaaaatcaaaaacgccctactgtccacaaacaaagccgtcgtctccctatccaacggcgtctcggtcctaacctttaaggttctcgatctcaaaaattacatagacaaacaactactccccatcctcaacaaacaatcttgctcaatccccaacatcgaaaccgtcatcgagttccaacagaaaaacaacagactactcgaaatcacccgcgagttctcagtcaacgcgggcgtcacaacacccgtcagcacctacatgctaaccaactccgaactcctcagcctcattaacgacatgcccatcaccaacgaccaaaagaaacttatgtccaacaacgttcaaatcgtccgccaacaatcctactccatcatgtgcatcatcaaagaagaagtactcgcctacgtagtccaactgcccctctacggcgtcatcgataccccatgctggaaactacacaccagccccctctgcaccaccaacaccaaagaaggctccaatatctgcttaacccgcacagaccgtggctggtactgcgataacgccggctccgtctccttcttcccccaagcagaaacctgcaaagtacaatccaaccgagtcttctgtgacaccatgaactccctaacccttccatcagaagtcaacctctgcaacatcgacatcttcaaccccaagtacgactgcaaaatcatgacatccaaaaccgatgtctcaagcagcgtcataacctcactcggcgctatcgtaagctgctacggcaaaaccaaatgcaccgcatcaaacaaaaaccgcggaatcatcaaaaccttcagcaacggatgcgactacgtttccaacaaaggcgtagacaccgtctccgtcggaaacaccctctactgcgtaaacaaacaggaaggccaatccctctacgtcaaaggcgaacccatcataaacttctacgatccccttgtcttcccgtccgatgagttcgacgcctccatctcgcaagtcaacgaaaagataaaccaatcactagcattcatccgtaaatccgacgaactcctccacaacgtcaacgtcggaaaatccaccaccaacataatgatcaccaccataatcatcgtcatcatcgtaatactattactcctcatagccgtcggcctcttcctatattgcaaagcccgatcaacccccgtaaccctttctaaagaccaactgtccggaatcaacaacatcgctttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14719 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut2 (opt1)
  source 1..1876: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14720 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut2 (opt1)
  source 1..1876: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14721 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut2 (opt2)
  source 1..1876: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14722 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut2 (opt3)
  source 1..1876: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagatcaactcagtggcattaataacatcgcattctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14723 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut2 (opt4)
  source 1..1876: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14724 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut2 (opt5)
  source 1..1876: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagatcaactctctgggatcaataacattgctttctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14725 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut2 (opt6)
  source 1..1876: mol_type = other RNA
gggagactttcccattctgtagcagaatttggtgttgcctgtggtcttggtcccgcggagaagcttaccatggagcttccaatattaaaaacaaacgctataacaactatactcgcagcagttacactctgcttcgcatcctcacaaaacataactgaagaattttaccaatccacttgctcagccgtatcaaaaggatatctaggagcacttagaaccggatggtatacatcagtgataacaatagaactaagcaacataaaagaaaacaagtgcaacggaactgacgcaaaagtcaaactaatcaaacaagaactagacaaatacaaaaacgcagtaacagacctacaattactaatgcaatcaacaccagcagcaggatcaggttcagccatatgctcaggtatcgctgtatgcaaagtccttcacctagaaggtgaagtaaacaaaattaaaaacgccctactcagtacaaataaagctgtcgtaagtttatcaaacggagtatcagtccttacattcaaagtattagacctaaaaaattatatagacaaacaattactaccaatactcaacaaacaatcatgctcaataccaaatatagaaaccgtaatagaatttcagcaaaaaaataacagattactagaaataaccagagaattttcagtcaacgcaggagtcacaacacccgtctcaacctacatgctaaccaactcagaacttctatctcttatcaacgacatgcccataaccaatgatcaaaaaaaattaatgtctaataacgttcaaatagtaagacaacaatcatactcaataatgtgcataatcaaagaagaagtattagcatacgtagtacaactacccctatatggagtaatagacacaccctgctggaaactacacacatcccccctctgtacaacaaacactaaagaaggatcaaacatttgcctaacaagaacagaccgcggatggtactgcgacaacgcaggctccgtatctttctttccacaagccgaaacttgtaaagttcaatcaaacagagtattttgcgatacaatgaactccttaacattaccttcagaagtaaacctatgcaacatagacatcttcaacccaaaatacgactgcaaaataatgacctcaaaaacagacgtatcctcatcagtcataacctccttaggagcaatagtatcatgttacggaaaaacaaaatgtacagcatcaaataaaaatagaggaataataaaaaccttctccaacggatgcgactacgtatccaataaaggagtagacaccgtatcagtaggaaacacactatactgtgtaaacaaacaagaaggccaatctctatatgtaaaaggcgaaccaatcataaatttttacgacccacttgtcttcccctccgacgaatttgacgcaagcatatcacaagtaaacgaaaaaatcaaccaaagcctagccttcataaggaaatctgacgaattacttcataacgtaaatgttggaaaatcaaccacaaacataatgataaccaccatcataattgtaataatagtaatactactactactaattgcagtaggactcttcctatattgcaaagctcgctcaacaccagttaccttatcaaaagaccaactatctggaataaacaacatagccttttccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14726 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut2 (opt11)
  source 1..1876: mol_type = other RNA
gggagactttcccattctgtagcagaatttggtgttgcctgtggtcttggtcccgcggagaagcttaccatggaactcccaatcctaaaaaccaacgccatcaccaccatcctcgccgctgtcaccttatgctttgccagcagccaaaacatcaccgaagaattttaccaatcaacatgctccgccgtctcaaaaggatacctcggcgccctacgcaccggctggtacacaagcgtcataaccatcgagctctccaacatcaaggaaaacaaatgcaatggaaccgacgccaaagtcaaactaatcaaacaagaactagacaagtacaagaacgcagtcaccgacctccaactcctcatgcagtccacccccgcagcaggctctggctcagcaatatgctccggcatcgctgtctgcaaagtcctacacctcgaaggcgaagtcaacaaaatcaaaaacgccctactgtccacaaacaaagccgtcgtctccctatccaacggcgtctcggtcctaacctttaaggttctcgatctcaaaaattacatagacaaacaactactccccatcctcaacaaacaatcttgctcaatccccaacatcgaaaccgtcatcgagttccaacagaaaaacaacagactactcgaaatcacccgcgagttctcagtcaacgcgggcgtcacaacacccgtcagcacctacatgctaaccaactccgaactcctcagcctcattaacgacatgcccatcaccaacgaccaaaagaaacttatgtccaacaacgttcaaatcgtccgccaacaatcctactccatcatgtgcatcatcaaagaagaagtactcgcctacgtagtccaactgcccctctacggcgtcatcgataccccatgctggaaactacacaccagccccctctgcaccaccaacaccaaagaaggctccaatatctgcttaacccgcacagaccgtggctggtactgcgataacgccggctccgtctccttcttcccccaagcagaaacctgcaaagtacaatccaaccgagtcttctgtgacaccatgaactccctaacccttccatcagaagtcaacctctgcaacatcgacatcttcaaccccaagtacgactgcaaaatcatgacatccaaaaccgatgtctcaagcagcgtcataacctcactcggcgctatcgtaagctgctacggcaaaaccaaatgcaccgcatcaaacaaaaaccgcggaatcatcaaaaccttcagcaacggatgcgactacgtttccaacaaaggcgtagacaccgtctccgtcggaaacaccctctactgcgtaaacaaacaggaaggccaatccctctacgtcaaaggcgaacccatcataaacttctacgatccccttgtcttcccgtccgatgagttcgacgcctccatctcgcaagtcaacgaaaagataaaccaatcactagcattcatccgtaaatccgacgaactcctccacaacgtcaacgtcggaaaatccaccaccaacataatgatcaccaccataatcatcgtcatcatcgtaatactattactcctcatagccgtcggcctcttcctatattgcaaagcccgatcaacccccgtaaccctttctaaagaccaactgtccggaatcaacaacatcgctttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14727 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut2 (opt1)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14728 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut2 (opt1)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14729 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut2 (opt2)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14730 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut2 (opt3)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagatcaactcagtggcattaataacatcgcattctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14731 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut2 (opt4)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14732 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut2 (opt5)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagatcaactctctgggatcaataacattgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14733 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut2 (opt6)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagcttccaatattaaaaacaaacgctataacaactatactcgcagcagttacactctgcttcgcatcctcacaaaacataactgaagaattttaccaatccacttgctcagccgtatcaaaaggatatctaggagcacttagaaccggatggtatacatcagtgataacaatagaactaagcaacataaaagaaaacaagtgcaacggaactgacgcaaaagtcaaactaatcaaacaagaactagacaaatacaaaaacgcagtaacagacctacaattactaatgcaatcaacaccagcagcaggatcaggttcagccatatgctcaggtatcgctgtatgcaaagtccttcacctagaaggtgaagtaaacaaaattaaaaacgccctactcagtacaaataaagctgtcgtaagtttatcaaacggagtatcagtccttacattcaaagtattagacctaaaaaattatatagacaaacaattactaccaatactcaacaaacaatcatgctcaataccaaatatagaaaccgtaatagaatttcagcaaaaaaataacagattactagaaataaccagagaattttcagtcaacgcaggagtcacaacacccgtctcaacctacatgctaaccaactcagaacttctatctcttatcaacgacatgcccataaccaatgatcaaaaaaaattaatgtctaataacgttcaaatagtaagacaacaatcatactcaataatgtgcataatcaaagaagaagtattagcatacgtagtacaactacccctatatggagtaatagacacaccctgctggaaactacacacatcccccctctgtacaacaaacactaaagaaggatcaaacatttgcctaacaagaacagaccgcggatggtactgcgacaacgcaggctccgtatctttctttccacaagccgaaacttgtaaagttcaatcaaacagagtattttgcgatacaatgaactccttaacattaccttcagaagtaaacctatgcaacatagacatcttcaacccaaaatacgactgcaaaataatgacctcaaaaacagacgtatcctcatcagtcataacctccttaggagcaatagtatcatgttacggaaaaacaaaatgtacagcatcaaataaaaatagaggaataataaaaaccttctccaacggatgcgactacgtatccaataaaggagtagacaccgtatcagtaggaaacacactatactgtgtaaacaaacaagaaggccaatctctatatgtaaaaggcgaaccaatcataaatttttacgacccacttgtcttcccctccgacgaatttgacgcaagcatatcacaagtaaacgaaaaaatcaaccaaagcctagccttcataaggaaatctgacgaattacttcataacgtaaatgttggaaaatcaaccacaaacataatgataaccaccatcataattgtaataatagtaatactactactactaattgcagtaggactcttcctatattgcaaagctcgctcaacaccagttaccttatcaaaagaccaactatctggaataaacaacatagccttttccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14734 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut2 (opt11)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactcccaatcctaaaaaccaacgccatcaccaccatcctcgccgctgtcaccttatgctttgccagcagccaaaacatcaccgaagaattttaccaatcaacatgctccgccgtctcaaaaggatacctcggcgccctacgcaccggctggtacacaagcgtcataaccatcgagctctccaacatcaaggaaaacaaatgcaatggaaccgacgccaaagtcaaactaatcaaacaagaactagacaagtacaagaacgcagtcaccgacctccaactcctcatgcagtccacccccgcagcaggctctggctcagcaatatgctccggcatcgctgtctgcaaagtcctacacctcgaaggcgaagtcaacaaaatcaaaaacgccctactgtccacaaacaaagccgtcgtctccctatccaacggcgtctcggtcctaacctttaaggttctcgatctcaaaaattacatagacaaacaactactccccatcctcaacaaacaatcttgctcaatccccaacatcgaaaccgtcatcgagttccaacagaaaaacaacagactactcgaaatcacccgcgagttctcagtcaacgcgggcgtcacaacacccgtcagcacctacatgctaaccaactccgaactcctcagcctcattaacgacatgcccatcaccaacgaccaaaagaaacttatgtccaacaacgttcaaatcgtccgccaacaatcctactccatcatgtgcatcatcaaagaagaagtactcgcctacgtagtccaactgcccctctacggcgtcatcgataccccatgctggaaactacacaccagccccctctgcaccaccaacaccaaagaaggctccaatatctgcttaacccgcacagaccgtggctggtactgcgataacgccggctccgtctccttcttcccccaagcagaaacctgcaaagtacaatccaaccgagtcttctgtgacaccatgaactccctaacccttccatcagaagtcaacctctgcaacatcgacatcttcaaccccaagtacgactgcaaaatcatgacatccaaaaccgatgtctcaagcagcgtcataacctcactcggcgctatcgtaagctgctacggcaaaaccaaatgcaccgcatcaaacaaaaaccgcggaatcatcaaaaccttcagcaacggatgcgactacgtttccaacaaaggcgtagacaccgtctccgtcggaaacaccctctactgcgtaaacaaacaggaaggccaatccctctacgtcaaaggcgaacccatcataaacttctacgatccccttgtcttcccgtccgatgagttcgacgcctccatctcgcaagtcaacgaaaagataaaccaatcactagcattcatccgtaaatccgacgaactcctccacaacgtcaacgtcggaaaatccaccaccaacataatgatcaccaccataatcatcgtcatcatcgtaatactattactcctcatagccgtcggcctcttcctatattgcaaagcccgatcaacccccgtaaccctttctaaagaccaactgtccggaatcaacaacatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14735 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut2 (opt1)
  source 1..1877: mol_type = other RNA
gggagagcctctgctggagtccggggagtggcgttggctgctagagcgaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14736 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut2 (opt1)
  source 1..1877: mol_type = other RNA
gggagagcctctgctggagtccggggagtggcgttggctgctagagcgaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14737 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut2 (opt2)
  source 1..1877: mol_type = other RNA
gggagagcctctgctggagtccggggagtggcgttggctgctagagcgaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14738 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut2 (opt3)
  source 1..1877: mol_type = other RNA
gggagagcctctgctggagtccggggagtggcgttggctgctagagcgaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagatcaactcagtggcattaataacatcgcattctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14739 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut2 (opt4)
  source 1..1877: mol_type = other RNA
gggagagcctctgctggagtccggggagtggcgttggctgctagagcgaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14740 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut2 (opt5)
  source 1..1877: mol_type = other RNA
gggagagcctctgctggagtccggggagtggcgttggctgctagagcgaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagatcaactctctgggatcaataacattgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14741 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut2 (opt6)
  source 1..1877: mol_type = other RNA
gggagagcctctgctggagtccggggagtggcgttggctgctagagcgaagcttaccatggagcttccaatattaaaaacaaacgctataacaactatactcgcagcagttacactctgcttcgcatcctcacaaaacataactgaagaattttaccaatccacttgctcagccgtatcaaaaggatatctaggagcacttagaaccggatggtatacatcagtgataacaatagaactaagcaacataaaagaaaacaagtgcaacggaactgacgcaaaagtcaaactaatcaaacaagaactagacaaatacaaaaacgcagtaacagacctacaattactaatgcaatcaacaccagcagcaggatcaggttcagccatatgctcaggtatcgctgtatgcaaagtccttcacctagaaggtgaagtaaacaaaattaaaaacgccctactcagtacaaataaagctgtcgtaagtttatcaaacggagtatcagtccttacattcaaagtattagacctaaaaaattatatagacaaacaattactaccaatactcaacaaacaatcatgctcaataccaaatatagaaaccgtaatagaatttcagcaaaaaaataacagattactagaaataaccagagaattttcagtcaacgcaggagtcacaacacccgtctcaacctacatgctaaccaactcagaacttctatctcttatcaacgacatgcccataaccaatgatcaaaaaaaattaatgtctaataacgttcaaatagtaagacaacaatcatactcaataatgtgcataatcaaagaagaagtattagcatacgtagtacaactacccctatatggagtaatagacacaccctgctggaaactacacacatcccccctctgtacaacaaacactaaagaaggatcaaacatttgcctaacaagaacagaccgcggatggtactgcgacaacgcaggctccgtatctttctttccacaagccgaaacttgtaaagttcaatcaaacagagtattttgcgatacaatgaactccttaacattaccttcagaagtaaacctatgcaacatagacatcttcaacccaaaatacgactgcaaaataatgacctcaaaaacagacgtatcctcatcagtcataacctccttaggagcaatagtatcatgttacggaaaaacaaaatgtacagcatcaaataaaaatagaggaataataaaaaccttctccaacggatgcgactacgtatccaataaaggagtagacaccgtatcagtaggaaacacactatactgtgtaaacaaacaagaaggccaatctctatatgtaaaaggcgaaccaatcataaatttttacgacccacttgtcttcccctccgacgaatttgacgcaagcatatcacaagtaaacgaaaaaatcaaccaaagcctagccttcataaggaaatctgacgaattacttcataacgtaaatgttggaaaatcaaccacaaacataatgataaccaccatcataattgtaataatagtaatactactactactaattgcagtaggactcttcctatattgcaaagctcgctcaacaccagttaccttatcaaaagaccaactatctggaataaacaacatagccttttccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14742 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut2 (opt11)
  source 1..1877: mol_type = other RNA
gggagagcctctgctggagtccggggagtggcgttggctgctagagcgaagcttaccatggaactcccaatcctaaaaaccaacgccatcaccaccatcctcgccgctgtcaccttatgctttgccagcagccaaaacatcaccgaagaattttaccaatcaacatgctccgccgtctcaaaaggatacctcggcgccctacgcaccggctggtacacaagcgtcataaccatcgagctctccaacatcaaggaaaacaaatgcaatggaaccgacgccaaagtcaaactaatcaaacaagaactagacaagtacaagaacgcagtcaccgacctccaactcctcatgcagtccacccccgcagcaggctctggctcagcaatatgctccggcatcgctgtctgcaaagtcctacacctcgaaggcgaagtcaacaaaatcaaaaacgccctactgtccacaaacaaagccgtcgtctccctatccaacggcgtctcggtcctaacctttaaggttctcgatctcaaaaattacatagacaaacaactactccccatcctcaacaaacaatcttgctcaatccccaacatcgaaaccgtcatcgagttccaacagaaaaacaacagactactcgaaatcacccgcgagttctcagtcaacgcgggcgtcacaacacccgtcagcacctacatgctaaccaactccgaactcctcagcctcattaacgacatgcccatcaccaacgaccaaaagaaacttatgtccaacaacgttcaaatcgtccgccaacaatcctactccatcatgtgcatcatcaaagaagaagtactcgcctacgtagtccaactgcccctctacggcgtcatcgataccccatgctggaaactacacaccagccccctctgcaccaccaacaccaaagaaggctccaatatctgcttaacccgcacagaccgtggctggtactgcgataacgccggctccgtctccttcttcccccaagcagaaacctgcaaagtacaatccaaccgagtcttctgtgacaccatgaactccctaacccttccatcagaagtcaacctctgcaacatcgacatcttcaaccccaagtacgactgcaaaatcatgacatccaaaaccgatgtctcaagcagcgtcataacctcactcggcgctatcgtaagctgctacggcaaaaccaaatgcaccgcatcaaacaaaaaccgcggaatcatcaaaaccttcagcaacggatgcgactacgtttccaacaaaggcgtagacaccgtctccgtcggaaacaccctctactgcgtaaacaaacaggaaggccaatccctctacgtcaaaggcgaacccatcataaacttctacgatccccttgtcttcccgtccgatgagttcgacgcctccatctcgcaagtcaacgaaaagataaaccaatcactagcattcatccgtaaatccgacgaactcctccacaacgtcaacgtcggaaaatccaccaccaacataatgatcaccaccataatcatcgtcatcatcgtaatactattactcctcatagccgtcggcctcttcctatattgcaaagcccgatcaacccccgtaaccctttctaaagaccaactgtccggaatcaacaacatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14743 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut2 (opt1)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14744 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut2 (opt1)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14745 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut2 (opt2)
  source 1..1897: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14746 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut2 (opt3)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagatcaactcagtggcattaataacatcgcattctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14747 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut2 (opt4)
  source 1..1897: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14748 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut2 (opt5)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagatcaactctctgggatcaataacattgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14749 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut2 (opt6)
  source 1..1897: mol_type = other RNA
gggagagtcccgcagtcggcgtccagcggctctgcttgttcgtgtgtgtgtcgttgcaggccttattcaagcttaccatggagcttccaatattaaaaacaaacgctataacaactatactcgcagcagttacactctgcttcgcatcctcacaaaacataactgaagaattttaccaatccacttgctcagccgtatcaaaaggatatctaggagcacttagaaccggatggtatacatcagtgataacaatagaactaagcaacataaaagaaaacaagtgcaacggaactgacgcaaaagtcaaactaatcaaacaagaactagacaaatacaaaaacgcagtaacagacctacaattactaatgcaatcaacaccagcagcaggatcaggttcagccatatgctcaggtatcgctgtatgcaaagtccttcacctagaaggtgaagtaaacaaaattaaaaacgccctactcagtacaaataaagctgtcgtaagtttatcaaacggagtatcagtccttacattcaaagtattagacctaaaaaattatatagacaaacaattactaccaatactcaacaaacaatcatgctcaataccaaatatagaaaccgtaatagaatttcagcaaaaaaataacagattactagaaataaccagagaattttcagtcaacgcaggagtcacaacacccgtctcaacctacatgctaaccaactcagaacttctatctcttatcaacgacatgcccataaccaatgatcaaaaaaaattaatgtctaataacgttcaaatagtaagacaacaatcatactcaataatgtgcataatcaaagaagaagtattagcatacgtagtacaactacccctatatggagtaatagacacaccctgctggaaactacacacatcccccctctgtacaacaaacactaaagaaggatcaaacatttgcctaacaagaacagaccgcggatggtactgcgacaacgcaggctccgtatctttctttccacaagccgaaacttgtaaagttcaatcaaacagagtattttgcgatacaatgaactccttaacattaccttcagaagtaaacctatgcaacatagacatcttcaacccaaaatacgactgcaaaataatgacctcaaaaacagacgtatcctcatcagtcataacctccttaggagcaatagtatcatgttacggaaaaacaaaatgtacagcatcaaataaaaatagaggaataataaaaaccttctccaacggatgcgactacgtatccaataaaggagtagacaccgtatcagtaggaaacacactatactgtgtaaacaaacaagaaggccaatctctatatgtaaaaggcgaaccaatcataaatttttacgacccacttgtcttcccctccgacgaatttgacgcaagcatatcacaagtaaacgaaaaaatcaaccaaagcctagccttcataaggaaatctgacgaattacttcataacgtaaatgttggaaaatcaaccacaaacataatgataaccaccatcataattgtaataatagtaatactactactactaattgcagtaggactcttcctatattgcaaagctcgctcaacaccagttaccttatcaaaagaccaactatctggaataaacaacatagccttttccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14750 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut2 (opt11)
  source 1..1897: mol_type = other RNA
gggagagtcccgcagtcggcgtccagcggctctgcttgttcgtgtgtgtgtcgttgcaggccttattcaagcttaccatggaactcccaatcctaaaaaccaacgccatcaccaccatcctcgccgctgtcaccttatgctttgccagcagccaaaacatcaccgaagaattttaccaatcaacatgctccgccgtctcaaaaggatacctcggcgccctacgcaccggctggtacacaagcgtcataaccatcgagctctccaacatcaaggaaaacaaatgcaatggaaccgacgccaaagtcaaactaatcaaacaagaactagacaagtacaagaacgcagtcaccgacctccaactcctcatgcagtccacccccgcagcaggctctggctcagcaatatgctccggcatcgctgtctgcaaagtcctacacctcgaaggcgaagtcaacaaaatcaaaaacgccctactgtccacaaacaaagccgtcgtctccctatccaacggcgtctcggtcctaacctttaaggttctcgatctcaaaaattacatagacaaacaactactccccatcctcaacaaacaatcttgctcaatccccaacatcgaaaccgtcatcgagttccaacagaaaaacaacagactactcgaaatcacccgcgagttctcagtcaacgcgggcgtcacaacacccgtcagcacctacatgctaaccaactccgaactcctcagcctcattaacgacatgcccatcaccaacgaccaaaagaaacttatgtccaacaacgttcaaatcgtccgccaacaatcctactccatcatgtgcatcatcaaagaagaagtactcgcctacgtagtccaactgcccctctacggcgtcatcgataccccatgctggaaactacacaccagccccctctgcaccaccaacaccaaagaaggctccaatatctgcttaacccgcacagaccgtggctggtactgcgataacgccggctccgtctccttcttcccccaagcagaaacctgcaaagtacaatccaaccgagtcttctgtgacaccatgaactccctaacccttccatcagaagtcaacctctgcaacatcgacatcttcaaccccaagtacgactgcaaaatcatgacatccaaaaccgatgtctcaagcagcgtcataacctcactcggcgctatcgtaagctgctacggcaaaaccaaatgcaccgcatcaaacaaaaaccgcggaatcatcaaaaccttcagcaacggatgcgactacgtttccaacaaaggcgtagacaccgtctccgtcggaaacaccctctactgcgtaaacaaacaggaaggccaatccctctacgtcaaaggcgaacccatcataaacttctacgatccccttgtcttcccgtccgatgagttcgacgcctccatctcgcaagtcaacgaaaagataaaccaatcactagcattcatccgtaaatccgacgaactcctccacaacgtcaacgtcggaaaatccaccaccaacataatgatcaccaccataatcatcgtcatcatcgtaatactattactcctcatagccgtcggcctcttcctatattgcaaagcccgatcaacccccgtaaccctttctaaagaccaactgtccggaatcaacaacatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14751 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut2 (opt1)
  source 1..1948: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14752 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut2 (opt1)
  source 1..1948: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14753 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut2 (opt2)
  source 1..1948: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14754 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut2 (opt3)
  source 1..1948: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagatcaactcagtggcattaataacatcgcattctctaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14755 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut2 (opt4)
  source 1..1948: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14756 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut2 (opt5)
  source 1..1948: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagatcaactctctgggatcaataacattgctttctccaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14757 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut2 (opt6)
  source 1..1948: mol_type = other RNA
gggagagtcccgcagtcggcgtccagcggctctgcttgttcgtgtgtgtgtcgttgcaggccttattcaagcttaccatggagcttccaatattaaaaacaaacgctataacaactatactcgcagcagttacactctgcttcgcatcctcacaaaacataactgaagaattttaccaatccacttgctcagccgtatcaaaaggatatctaggagcacttagaaccggatggtatacatcagtgataacaatagaactaagcaacataaaagaaaacaagtgcaacggaactgacgcaaaagtcaaactaatcaaacaagaactagacaaatacaaaaacgcagtaacagacctacaattactaatgcaatcaacaccagcagcaggatcaggttcagccatatgctcaggtatcgctgtatgcaaagtccttcacctagaaggtgaagtaaacaaaattaaaaacgccctactcagtacaaataaagctgtcgtaagtttatcaaacggagtatcagtccttacattcaaagtattagacctaaaaaattatatagacaaacaattactaccaatactcaacaaacaatcatgctcaataccaaatatagaaaccgtaatagaatttcagcaaaaaaataacagattactagaaataaccagagaattttcagtcaacgcaggagtcacaacacccgtctcaacctacatgctaaccaactcagaacttctatctcttatcaacgacatgcccataaccaatgatcaaaaaaaattaatgtctaataacgttcaaatagtaagacaacaatcatactcaataatgtgcataatcaaagaagaagtattagcatacgtagtacaactacccctatatggagtaatagacacaccctgctggaaactacacacatcccccctctgtacaacaaacactaaagaaggatcaaacatttgcctaacaagaacagaccgcggatggtactgcgacaacgcaggctccgtatctttctttccacaagccgaaacttgtaaagttcaatcaaacagagtattttgcgatacaatgaactccttaacattaccttcagaagtaaacctatgcaacatagacatcttcaacccaaaatacgactgcaaaataatgacctcaaaaacagacgtatcctcatcagtcataacctccttaggagcaatagtatcatgttacggaaaaacaaaatgtacagcatcaaataaaaatagaggaataataaaaaccttctccaacggatgcgactacgtatccaataaaggagtagacaccgtatcagtaggaaacacactatactgtgtaaacaaacaagaaggccaatctctatatgtaaaaggcgaaccaatcataaatttttacgacccacttgtcttcccctccgacgaatttgacgcaagcatatcacaagtaaacgaaaaaatcaaccaaagcctagccttcataaggaaatctgacgaattacttcataacgtaaatgttggaaaatcaaccacaaacataatgataaccaccatcataattgtaataatagtaatactactactactaattgcagtaggactcttcctatattgcaaagctcgctcaacaccagttaccttatcaaaagaccaactatctggaataaacaacatagccttttccaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14758 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut2 (opt11)
  source 1..1948: mol_type = other RNA
gggagagtcccgcagtcggcgtccagcggctctgcttgttcgtgtgtgtgtcgttgcaggccttattcaagcttaccatggaactcccaatcctaaaaaccaacgccatcaccaccatcctcgccgctgtcaccttatgctttgccagcagccaaaacatcaccgaagaattttaccaatcaacatgctccgccgtctcaaaaggatacctcggcgccctacgcaccggctggtacacaagcgtcataaccatcgagctctccaacatcaaggaaaacaaatgcaatggaaccgacgccaaagtcaaactaatcaaacaagaactagacaagtacaagaacgcagtcaccgacctccaactcctcatgcagtccacccccgcagcaggctctggctcagcaatatgctccggcatcgctgtctgcaaagtcctacacctcgaaggcgaagtcaacaaaatcaaaaacgccctactgtccacaaacaaagccgtcgtctccctatccaacggcgtctcggtcctaacctttaaggttctcgatctcaaaaattacatagacaaacaactactccccatcctcaacaaacaatcttgctcaatccccaacatcgaaaccgtcatcgagttccaacagaaaaacaacagactactcgaaatcacccgcgagttctcagtcaacgcgggcgtcacaacacccgtcagcacctacatgctaaccaactccgaactcctcagcctcattaacgacatgcccatcaccaacgaccaaaagaaacttatgtccaacaacgttcaaatcgtccgccaacaatcctactccatcatgtgcatcatcaaagaagaagtactcgcctacgtagtccaactgcccctctacggcgtcatcgataccccatgctggaaactacacaccagccccctctgcaccaccaacaccaaagaaggctccaatatctgcttaacccgcacagaccgtggctggtactgcgataacgccggctccgtctccttcttcccccaagcagaaacctgcaaagtacaatccaaccgagtcttctgtgacaccatgaactccctaacccttccatcagaagtcaacctctgcaacatcgacatcttcaaccccaagtacgactgcaaaatcatgacatccaaaaccgatgtctcaagcagcgtcataacctcactcggcgctatcgtaagctgctacggcaaaaccaaatgcaccgcatcaaacaaaaaccgcggaatcatcaaaaccttcagcaacggatgcgactacgtttccaacaaaggcgtagacaccgtctccgtcggaaacaccctctactgcgtaaacaaacaggaaggccaatccctctacgtcaaaggcgaacccatcataaacttctacgatccccttgtcttcccgtccgatgagttcgacgcctccatctcgcaagtcaacgaaaagataaaccaatcactagcattcatccgtaaatccgacgaactcctccacaacgtcaacgtcggaaaatccaccaccaacataatgatcaccaccataatcatcgtcatcatcgtaatactattactcctcatagccgtcggcctcttcctatattgcaaagcccgatcaacccccgtaaccctttctaaagaccaactgtccggaatcaacaacatcgctttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14759 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut2 (opt1)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14760 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut2 (opt1)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14761 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut2 (opt2)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14762 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut2 (opt3)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagatcaactcagtggcattaataacatcgcattctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14763 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut2 (opt4)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14764 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut2 (opt5)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagatcaactctctgggatcaataacattgctttctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14765 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut2 (opt6)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagcttccaatattaaaaacaaacgctataacaactatactcgcagcagttacactctgcttcgcatcctcacaaaacataactgaagaattttaccaatccacttgctcagccgtatcaaaaggatatctaggagcacttagaaccggatggtatacatcagtgataacaatagaactaagcaacataaaagaaaacaagtgcaacggaactgacgcaaaagtcaaactaatcaaacaagaactagacaaatacaaaaacgcagtaacagacctacaattactaatgcaatcaacaccagcagcaggatcaggttcagccatatgctcaggtatcgctgtatgcaaagtccttcacctagaaggtgaagtaaacaaaattaaaaacgccctactcagtacaaataaagctgtcgtaagtttatcaaacggagtatcagtccttacattcaaagtattagacctaaaaaattatatagacaaacaattactaccaatactcaacaaacaatcatgctcaataccaaatatagaaaccgtaatagaatttcagcaaaaaaataacagattactagaaataaccagagaattttcagtcaacgcaggagtcacaacacccgtctcaacctacatgctaaccaactcagaacttctatctcttatcaacgacatgcccataaccaatgatcaaaaaaaattaatgtctaataacgttcaaatagtaagacaacaatcatactcaataatgtgcataatcaaagaagaagtattagcatacgtagtacaactacccctatatggagtaatagacacaccctgctggaaactacacacatcccccctctgtacaacaaacactaaagaaggatcaaacatttgcctaacaagaacagaccgcggatggtactgcgacaacgcaggctccgtatctttctttccacaagccgaaacttgtaaagttcaatcaaacagagtattttgcgatacaatgaactccttaacattaccttcagaagtaaacctatgcaacatagacatcttcaacccaaaatacgactgcaaaataatgacctcaaaaacagacgtatcctcatcagtcataacctccttaggagcaatagtatcatgttacggaaaaacaaaatgtacagcatcaaataaaaatagaggaataataaaaaccttctccaacggatgcgactacgtatccaataaaggagtagacaccgtatcagtaggaaacacactatactgtgtaaacaaacaagaaggccaatctctatatgtaaaaggcgaaccaatcataaatttttacgacccacttgtcttcccctccgacgaatttgacgcaagcatatcacaagtaaacgaaaaaatcaaccaaagcctagccttcataaggaaatctgacgaattacttcataacgtaaatgttggaaaatcaaccacaaacataatgataaccaccatcataattgtaataatagtaatactactactactaattgcagtaggactcttcctatattgcaaagctcgctcaacaccagttaccttatcaaaagaccaactatctggaataaacaacatagccttttccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14766 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut2 (opt11)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcccaatcctaaaaaccaacgccatcaccaccatcctcgccgctgtcaccttatgctttgccagcagccaaaacatcaccgaagaattttaccaatcaacatgctccgccgtctcaaaaggatacctcggcgccctacgcaccggctggtacacaagcgtcataaccatcgagctctccaacatcaaggaaaacaaatgcaatggaaccgacgccaaagtcaaactaatcaaacaagaactagacaagtacaagaacgcagtcaccgacctccaactcctcatgcagtccacccccgcagcaggctctggctcagcaatatgctccggcatcgctgtctgcaaagtcctacacctcgaaggcgaagtcaacaaaatcaaaaacgccctactgtccacaaacaaagccgtcgtctccctatccaacggcgtctcggtcctaacctttaaggttctcgatctcaaaaattacatagacaaacaactactccccatcctcaacaaacaatcttgctcaatccccaacatcgaaaccgtcatcgagttccaacagaaaaacaacagactactcgaaatcacccgcgagttctcagtcaacgcgggcgtcacaacacccgtcagcacctacatgctaaccaactccgaactcctcagcctcattaacgacatgcccatcaccaacgaccaaaagaaacttatgtccaacaacgttcaaatcgtccgccaacaatcctactccatcatgtgcatcatcaaagaagaagtactcgcctacgtagtccaactgcccctctacggcgtcatcgataccccatgctggaaactacacaccagccccctctgcaccaccaacaccaaagaaggctccaatatctgcttaacccgcacagaccgtggctggtactgcgataacgccggctccgtctccttcttcccccaagcagaaacctgcaaagtacaatccaaccgagtcttctgtgacaccatgaactccctaacccttccatcagaagtcaacctctgcaacatcgacatcttcaaccccaagtacgactgcaaaatcatgacatccaaaaccgatgtctcaagcagcgtcataacctcactcggcgctatcgtaagctgctacggcaaaaccaaatgcaccgcatcaaacaaaaaccgcggaatcatcaaaaccttcagcaacggatgcgactacgtttccaacaaaggcgtagacaccgtctccgtcggaaacaccctctactgcgtaaacaaacaggaaggccaatccctctacgtcaaaggcgaacccatcataaacttctacgatccccttgtcttcccgtccgatgagttcgacgcctccatctcgcaagtcaacgaaaagataaaccaatcactagcattcatccgtaaatccgacgaactcctccacaacgtcaacgtcggaaaatccaccaccaacataatgatcaccaccataatcatcgtcatcatcgtaatactattactcctcatagccgtcggcctcttcctatattgcaaagcccgatcaacccccgtaaccctttctaaagaccaactgtccggaatcaacaacatcgctttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14767 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut2 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14768 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut2 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14769 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut2 (opt2)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14770 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut2 (opt3)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagatcaactcagtggcattaataacatcgcattctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14771 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut2 (opt4)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14772 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut2 (opt5)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagatcaactctctgggatcaataacattgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14773 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut2 (opt6)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagcttccaatattaaaaacaaacgctataacaactatactcgcagcagttacactctgcttcgcatcctcacaaaacataactgaagaattttaccaatccacttgctcagccgtatcaaaaggatatctaggagcacttagaaccggatggtatacatcagtgataacaatagaactaagcaacataaaagaaaacaagtgcaacggaactgacgcaaaagtcaaactaatcaaacaagaactagacaaatacaaaaacgcagtaacagacctacaattactaatgcaatcaacaccagcagcaggatcaggttcagccatatgctcaggtatcgctgtatgcaaagtccttcacctagaaggtgaagtaaacaaaattaaaaacgccctactcagtacaaataaagctgtcgtaagtttatcaaacggagtatcagtccttacattcaaagtattagacctaaaaaattatatagacaaacaattactaccaatactcaacaaacaatcatgctcaataccaaatatagaaaccgtaatagaatttcagcaaaaaaataacagattactagaaataaccagagaattttcagtcaacgcaggagtcacaacacccgtctcaacctacatgctaaccaactcagaacttctatctcttatcaacgacatgcccataaccaatgatcaaaaaaaattaatgtctaataacgttcaaatagtaagacaacaatcatactcaataatgtgcataatcaaagaagaagtattagcatacgtagtacaactacccctatatggagtaatagacacaccctgctggaaactacacacatcccccctctgtacaacaaacactaaagaaggatcaaacatttgcctaacaagaacagaccgcggatggtactgcgacaacgcaggctccgtatctttctttccacaagccgaaacttgtaaagttcaatcaaacagagtattttgcgatacaatgaactccttaacattaccttcagaagtaaacctatgcaacatagacatcttcaacccaaaatacgactgcaaaataatgacctcaaaaacagacgtatcctcatcagtcataacctccttaggagcaatagtatcatgttacggaaaaacaaaatgtacagcatcaaataaaaatagaggaataataaaaaccttctccaacggatgcgactacgtatccaataaaggagtagacaccgtatcagtaggaaacacactatactgtgtaaacaaacaagaaggccaatctctatatgtaaaaggcgaaccaatcataaatttttacgacccacttgtcttcccctccgacgaatttgacgcaagcatatcacaagtaaacgaaaaaatcaaccaaagcctagccttcataaggaaatctgacgaattacttcataacgtaaatgttggaaaatcaaccacaaacataatgataaccaccatcataattgtaataatagtaatactactactactaattgcagtaggactcttcctatattgcaaagctcgctcaacaccagttaccttatcaaaagaccaactatctggaataaacaacatagccttttccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14774 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut2 (opt11)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaactcccaatcctaaaaaccaacgccatcaccaccatcctcgccgctgtcaccttatgctttgccagcagccaaaacatcaccgaagaattttaccaatcaacatgctccgccgtctcaaaaggatacctcggcgccctacgcaccggctggtacacaagcgtcataaccatcgagctctccaacatcaaggaaaacaaatgcaatggaaccgacgccaaagtcaaactaatcaaacaagaactagacaagtacaagaacgcagtcaccgacctccaactcctcatgcagtccacccccgcagcaggctctggctcagcaatatgctccggcatcgctgtctgcaaagtcctacacctcgaaggcgaagtcaacaaaatcaaaaacgccctactgtccacaaacaaagccgtcgtctccctatccaacggcgtctcggtcctaacctttaaggttctcgatctcaaaaattacatagacaaacaactactccccatcctcaacaaacaatcttgctcaatccccaacatcgaaaccgtcatcgagttccaacagaaaaacaacagactactcgaaatcacccgcgagttctcagtcaacgcgggcgtcacaacacccgtcagcacctacatgctaaccaactccgaactcctcagcctcattaacgacatgcccatcaccaacgaccaaaagaaacttatgtccaacaacgttcaaatcgtccgccaacaatcctactccatcatgtgcatcatcaaagaagaagtactcgcctacgtagtccaactgcccctctacggcgtcatcgataccccatgctggaaactacacaccagccccctctgcaccaccaacaccaaagaaggctccaatatctgcttaacccgcacagaccgtggctggtactgcgataacgccggctccgtctccttcttcccccaagcagaaacctgcaaagtacaatccaaccgagtcttctgtgacaccatgaactccctaacccttccatcagaagtcaacctctgcaacatcgacatcttcaaccccaagtacgactgcaaaatcatgacatccaaaaccgatgtctcaagcagcgtcataacctcactcggcgctatcgtaagctgctacggcaaaaccaaatgcaccgcatcaaacaaaaaccgcggaatcatcaaaaccttcagcaacggatgcgactacgtttccaacaaaggcgtagacaccgtctccgtcggaaacaccctctactgcgtaaacaaacaggaaggccaatccctctacgtcaaaggcgaacccatcataaacttctacgatccccttgtcttcccgtccgatgagttcgacgcctccatctcgcaagtcaacgaaaagataaaccaatcactagcattcatccgtaaatccgacgaactcctccacaacgtcaacgtcggaaaatccaccaccaacataatgatcaccaccataatcatcgtcatcatcgtaatactattactcctcatagccgtcggcctcttcctatattgcaaagcccgatcaacccccgtaaccctttctaaagaccaactgtccggaatcaacaacatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14775 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut2 (opt1)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14776 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut2 (opt1)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14777 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut2 (opt2)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14778 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut2 (opt3)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagatcaactcagtggcattaataacatcgcattctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14779 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut2 (opt4)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14780 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut2 (opt5)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagatcaactctctgggatcaataacattgctttctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14781 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut2 (opt6)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagcttccaatattaaaaacaaacgctataacaactatactcgcagcagttacactctgcttcgcatcctcacaaaacataactgaagaattttaccaatccacttgctcagccgtatcaaaaggatatctaggagcacttagaaccggatggtatacatcagtgataacaatagaactaagcaacataaaagaaaacaagtgcaacggaactgacgcaaaagtcaaactaatcaaacaagaactagacaaatacaaaaacgcagtaacagacctacaattactaatgcaatcaacaccagcagcaggatcaggttcagccatatgctcaggtatcgctgtatgcaaagtccttcacctagaaggtgaagtaaacaaaattaaaaacgccctactcagtacaaataaagctgtcgtaagtttatcaaacggagtatcagtccttacattcaaagtattagacctaaaaaattatatagacaaacaattactaccaatactcaacaaacaatcatgctcaataccaaatatagaaaccgtaatagaatttcagcaaaaaaataacagattactagaaataaccagagaattttcagtcaacgcaggagtcacaacacccgtctcaacctacatgctaaccaactcagaacttctatctcttatcaacgacatgcccataaccaatgatcaaaaaaaattaatgtctaataacgttcaaatagtaagacaacaatcatactcaataatgtgcataatcaaagaagaagtattagcatacgtagtacaactacccctatatggagtaatagacacaccctgctggaaactacacacatcccccctctgtacaacaaacactaaagaaggatcaaacatttgcctaacaagaacagaccgcggatggtactgcgacaacgcaggctccgtatctttctttccacaagccgaaacttgtaaagttcaatcaaacagagtattttgcgatacaatgaactccttaacattaccttcagaagtaaacctatgcaacatagacatcttcaacccaaaatacgactgcaaaataatgacctcaaaaacagacgtatcctcatcagtcataacctccttaggagcaatagtatcatgttacggaaaaacaaaatgtacagcatcaaataaaaatagaggaataataaaaaccttctccaacggatgcgactacgtatccaataaaggagtagacaccgtatcagtaggaaacacactatactgtgtaaacaaacaagaaggccaatctctatatgtaaaaggcgaaccaatcataaatttttacgacccacttgtcttcccctccgacgaatttgacgcaagcatatcacaagtaaacgaaaaaatcaaccaaagcctagccttcataaggaaatctgacgaattacttcataacgtaaatgttggaaaatcaaccacaaacataatgataaccaccatcataattgtaataatagtaatactactactactaattgcagtaggactcttcctatattgcaaagctcgctcaacaccagttaccttatcaaaagaccaactatctggaataaacaacatagccttttccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14782 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut2 (opt11)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcccaatcctaaaaaccaacgccatcaccaccatcctcgccgctgtcaccttatgctttgccagcagccaaaacatcaccgaagaattttaccaatcaacatgctccgccgtctcaaaaggatacctcggcgccctacgcaccggctggtacacaagcgtcataaccatcgagctctccaacatcaaggaaaacaaatgcaatggaaccgacgccaaagtcaaactaatcaaacaagaactagacaagtacaagaacgcagtcaccgacctccaactcctcatgcagtccacccccgcagcaggctctggctcagcaatatgctccggcatcgctgtctgcaaagtcctacacctcgaaggcgaagtcaacaaaatcaaaaacgccctactgtccacaaacaaagccgtcgtctccctatccaacggcgtctcggtcctaacctttaaggttctcgatctcaaaaattacatagacaaacaactactccccatcctcaacaaacaatcttgctcaatccccaacatcgaaaccgtcatcgagttccaacagaaaaacaacagactactcgaaatcacccgcgagttctcagtcaacgcgggcgtcacaacacccgtcagcacctacatgctaaccaactccgaactcctcagcctcattaacgacatgcccatcaccaacgaccaaaagaaacttatgtccaacaacgttcaaatcgtccgccaacaatcctactccatcatgtgcatcatcaaagaagaagtactcgcctacgtagtccaactgcccctctacggcgtcatcgataccccatgctggaaactacacaccagccccctctgcaccaccaacaccaaagaaggctccaatatctgcttaacccgcacagaccgtggctggtactgcgataacgccggctccgtctccttcttcccccaagcagaaacctgcaaagtacaatccaaccgagtcttctgtgacaccatgaactccctaacccttccatcagaagtcaacctctgcaacatcgacatcttcaaccccaagtacgactgcaaaatcatgacatccaaaaccgatgtctcaagcagcgtcataacctcactcggcgctatcgtaagctgctacggcaaaaccaaatgcaccgcatcaaacaaaaaccgcggaatcatcaaaaccttcagcaacggatgcgactacgtttccaacaaaggcgtagacaccgtctccgtcggaaacaccctctactgcgtaaacaaacaggaaggccaatccctctacgtcaaaggcgaacccatcataaacttctacgatccccttgtcttcccgtccgatgagttcgacgcctccatctcgcaagtcaacgaaaagataaaccaatcactagcattcatccgtaaatccgacgaactcctccacaacgtcaacgtcggaaaatccaccaccaacataatgatcaccaccataatcatcgtcatcatcgtaatactattactcctcatagccgtcggcctcttcctatattgcaaagcccgatcaacccccgtaaccctttctaaagaccaactgtccggaatcaacaacatcgctttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14783 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut2 (opt1)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14784 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut2 (opt1)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14785 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut2 (opt2)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14786 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut2 (opt3)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagatcaactcagtggcattaataacatcgcattctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14787 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut2 (opt4)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14788 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut2 (opt5)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagatcaactctctgggatcaataacattgctttctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14789 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut2 (opt6)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagcttccaatattaaaaacaaacgctataacaactatactcgcagcagttacactctgcttcgcatcctcacaaaacataactgaagaattttaccaatccacttgctcagccgtatcaaaaggatatctaggagcacttagaaccggatggtatacatcagtgataacaatagaactaagcaacataaaagaaaacaagtgcaacggaactgacgcaaaagtcaaactaatcaaacaagaactagacaaatacaaaaacgcagtaacagacctacaattactaatgcaatcaacaccagcagcaggatcaggttcagccatatgctcaggtatcgctgtatgcaaagtccttcacctagaaggtgaagtaaacaaaattaaaaacgccctactcagtacaaataaagctgtcgtaagtttatcaaacggagtatcagtccttacattcaaagtattagacctaaaaaattatatagacaaacaattactaccaatactcaacaaacaatcatgctcaataccaaatatagaaaccgtaatagaatttcagcaaaaaaataacagattactagaaataaccagagaattttcagtcaacgcaggagtcacaacacccgtctcaacctacatgctaaccaactcagaacttctatctcttatcaacgacatgcccataaccaatgatcaaaaaaaattaatgtctaataacgttcaaatagtaagacaacaatcatactcaataatgtgcataatcaaagaagaagtattagcatacgtagtacaactacccctatatggagtaatagacacaccctgctggaaactacacacatcccccctctgtacaacaaacactaaagaaggatcaaacatttgcctaacaagaacagaccgcggatggtactgcgacaacgcaggctccgtatctttctttccacaagccgaaacttgtaaagttcaatcaaacagagtattttgcgatacaatgaactccttaacattaccttcagaagtaaacctatgcaacatagacatcttcaacccaaaatacgactgcaaaataatgacctcaaaaacagacgtatcctcatcagtcataacctccttaggagcaatagtatcatgttacggaaaaacaaaatgtacagcatcaaataaaaatagaggaataataaaaaccttctccaacggatgcgactacgtatccaataaaggagtagacaccgtatcagtaggaaacacactatactgtgtaaacaaacaagaaggccaatctctatatgtaaaaggcgaaccaatcataaatttttacgacccacttgtcttcccctccgacgaatttgacgcaagcatatcacaagtaaacgaaaaaatcaaccaaagcctagccttcataaggaaatctgacgaattacttcataacgtaaatgttggaaaatcaaccacaaacataatgataaccaccatcataattgtaataatagtaatactactactactaattgcagtaggactcttcctatattgcaaagctcgctcaacaccagttaccttatcaaaagaccaactatctggaataaacaacatagccttttccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14790 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut2 (opt11)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggaactcccaatcctaaaaaccaacgccatcaccaccatcctcgccgctgtcaccttatgctttgccagcagccaaaacatcaccgaagaattttaccaatcaacatgctccgccgtctcaaaaggatacctcggcgccctacgcaccggctggtacacaagcgtcataaccatcgagctctccaacatcaaggaaaacaaatgcaatggaaccgacgccaaagtcaaactaatcaaacaagaactagacaagtacaagaacgcagtcaccgacctccaactcctcatgcagtccacccccgcagcaggctctggctcagcaatatgctccggcatcgctgtctgcaaagtcctacacctcgaaggcgaagtcaacaaaatcaaaaacgccctactgtccacaaacaaagccgtcgtctccctatccaacggcgtctcggtcctaacctttaaggttctcgatctcaaaaattacatagacaaacaactactccccatcctcaacaaacaatcttgctcaatccccaacatcgaaaccgtcatcgagttccaacagaaaaacaacagactactcgaaatcacccgcgagttctcagtcaacgcgggcgtcacaacacccgtcagcacctacatgctaaccaactccgaactcctcagcctcattaacgacatgcccatcaccaacgaccaaaagaaacttatgtccaacaacgttcaaatcgtccgccaacaatcctactccatcatgtgcatcatcaaagaagaagtactcgcctacgtagtccaactgcccctctacggcgtcatcgataccccatgctggaaactacacaccagccccctctgcaccaccaacaccaaagaaggctccaatatctgcttaacccgcacagaccgtggctggtactgcgataacgccggctccgtctccttcttcccccaagcagaaacctgcaaagtacaatccaaccgagtcttctgtgacaccatgaactccctaacccttccatcagaagtcaacctctgcaacatcgacatcttcaaccccaagtacgactgcaaaatcatgacatccaaaaccgatgtctcaagcagcgtcataacctcactcggcgctatcgtaagctgctacggcaaaaccaaatgcaccgcatcaaacaaaaaccgcggaatcatcaaaaccttcagcaacggatgcgactacgtttccaacaaaggcgtagacaccgtctccgtcggaaacaccctctactgcgtaaacaaacaggaaggccaatccctctacgtcaaaggcgaacccatcataaacttctacgatccccttgtcttcccgtccgatgagttcgacgcctccatctcgcaagtcaacgaaaagataaaccaatcactagcattcatccgtaaatccgacgaactcctccacaacgtcaacgtcggaaaatccaccaccaacataatgatcaccaccataatcatcgtcatcatcgtaatactattactcctcatagccgtcggcctcttcctatattgcaaagcccgatcaacccccgtaaccctttctaaagaccaactgtccggaatcaacaacatcgctttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14791 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut2 (opt1)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14792 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut2 (opt1)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14793 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut2 (opt2)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14794 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut2 (opt3)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagatcaactcagtggcattaataacatcgcattctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14795 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut2 (opt4)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14796 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut2 (opt5)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagatcaactctctgggatcaataacattgctttctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14797 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut2 (opt6)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagcttccaatattaaaaacaaacgctataacaactatactcgcagcagttacactctgcttcgcatcctcacaaaacataactgaagaattttaccaatccacttgctcagccgtatcaaaaggatatctaggagcacttagaaccggatggtatacatcagtgataacaatagaactaagcaacataaaagaaaacaagtgcaacggaactgacgcaaaagtcaaactaatcaaacaagaactagacaaatacaaaaacgcagtaacagacctacaattactaatgcaatcaacaccagcagcaggatcaggttcagccatatgctcaggtatcgctgtatgcaaagtccttcacctagaaggtgaagtaaacaaaattaaaaacgccctactcagtacaaataaagctgtcgtaagtttatcaaacggagtatcagtccttacattcaaagtattagacctaaaaaattatatagacaaacaattactaccaatactcaacaaacaatcatgctcaataccaaatatagaaaccgtaatagaatttcagcaaaaaaataacagattactagaaataaccagagaattttcagtcaacgcaggagtcacaacacccgtctcaacctacatgctaaccaactcagaacttctatctcttatcaacgacatgcccataaccaatgatcaaaaaaaattaatgtctaataacgttcaaatagtaagacaacaatcatactcaataatgtgcataatcaaagaagaagtattagcatacgtagtacaactacccctatatggagtaatagacacaccctgctggaaactacacacatcccccctctgtacaacaaacactaaagaaggatcaaacatttgcctaacaagaacagaccgcggatggtactgcgacaacgcaggctccgtatctttctttccacaagccgaaacttgtaaagttcaatcaaacagagtattttgcgatacaatgaactccttaacattaccttcagaagtaaacctatgcaacatagacatcttcaacccaaaatacgactgcaaaataatgacctcaaaaacagacgtatcctcatcagtcataacctccttaggagcaatagtatcatgttacggaaaaacaaaatgtacagcatcaaataaaaatagaggaataataaaaaccttctccaacggatgcgactacgtatccaataaaggagtagacaccgtatcagtaggaaacacactatactgtgtaaacaaacaagaaggccaatctctatatgtaaaaggcgaaccaatcataaatttttacgacccacttgtcttcccctccgacgaatttgacgcaagcatatcacaagtaaacgaaaaaatcaaccaaagcctagccttcataaggaaatctgacgaattacttcataacgtaaatgttggaaaatcaaccacaaacataatgataaccaccatcataattgtaataatagtaatactactactactaattgcagtaggactcttcctatattgcaaagctcgctcaacaccagttaccttatcaaaagaccaactatctggaataaacaacatagccttttccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14798 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut2 (opt11)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggaactcccaatcctaaaaaccaacgccatcaccaccatcctcgccgctgtcaccttatgctttgccagcagccaaaacatcaccgaagaattttaccaatcaacatgctccgccgtctcaaaaggatacctcggcgccctacgcaccggctggtacacaagcgtcataaccatcgagctctccaacatcaaggaaaacaaatgcaatggaaccgacgccaaagtcaaactaatcaaacaagaactagacaagtacaagaacgcagtcaccgacctccaactcctcatgcagtccacccccgcagcaggctctggctcagcaatatgctccggcatcgctgtctgcaaagtcctacacctcgaaggcgaagtcaacaaaatcaaaaacgccctactgtccacaaacaaagccgtcgtctccctatccaacggcgtctcggtcctaacctttaaggttctcgatctcaaaaattacatagacaaacaactactccccatcctcaacaaacaatcttgctcaatccccaacatcgaaaccgtcatcgagttccaacagaaaaacaacagactactcgaaatcacccgcgagttctcagtcaacgcgggcgtcacaacacccgtcagcacctacatgctaaccaactccgaactcctcagcctcattaacgacatgcccatcaccaacgaccaaaagaaacttatgtccaacaacgttcaaatcgtccgccaacaatcctactccatcatgtgcatcatcaaagaagaagtactcgcctacgtagtccaactgcccctctacggcgtcatcgataccccatgctggaaactacacaccagccccctctgcaccaccaacaccaaagaaggctccaatatctgcttaacccgcacagaccgtggctggtactgcgataacgccggctccgtctccttcttcccccaagcagaaacctgcaaagtacaatccaaccgagtcttctgtgacaccatgaactccctaacccttccatcagaagtcaacctctgcaacatcgacatcttcaaccccaagtacgactgcaaaatcatgacatccaaaaccgatgtctcaagcagcgtcataacctcactcggcgctatcgtaagctgctacggcaaaaccaaatgcaccgcatcaaacaaaaaccgcggaatcatcaaaaccttcagcaacggatgcgactacgtttccaacaaaggcgtagacaccgtctccgtcggaaacaccctctactgcgtaaacaaacaggaaggccaatccctctacgtcaaaggcgaacccatcataaacttctacgatccccttgtcttcccgtccgatgagttcgacgcctccatctcgcaagtcaacgaaaagataaaccaatcactagcattcatccgtaaatccgacgaactcctccacaacgtcaacgtcggaaaatccaccaccaacataatgatcaccaccataatcatcgtcatcatcgtaatactattactcctcatagccgtcggcctcttcctatattgcaaagcccgatcaacccccgtaaccctttctaaagaccaactgtccggaatcaacaacatcgctttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14799 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut2 (opt1)
  source 1..1897: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14800 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut2 (opt1)
  source 1..1897: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14801 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut2 (opt2)
  source 1..1897: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14802 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut2 (opt3)
  source 1..1897: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagatcaactcagtggcattaataacatcgcattctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14803 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut2 (opt4)
  source 1..1897: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14804 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut2 (opt5)
  source 1..1897: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagatcaactctctgggatcaataacattgctttctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14805 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut2 (opt6)
  source 1..1897: mol_type = other RNA
gggagagcggctcggccattttgtcccagtcagtccggaggctgcggctgcagaagtaccgcctgcggagtaactgcaaagaagcttaccatggagcttccaatattaaaaacaaacgctataacaactatactcgcagcagttacactctgcttcgcatcctcacaaaacataactgaagaattttaccaatccacttgctcagccgtatcaaaaggatatctaggagcacttagaaccggatggtatacatcagtgataacaatagaactaagcaacataaaagaaaacaagtgcaacggaactgacgcaaaagtcaaactaatcaaacaagaactagacaaatacaaaaacgcagtaacagacctacaattactaatgcaatcaacaccagcagcaggatcaggttcagccatatgctcaggtatcgctgtatgcaaagtccttcacctagaaggtgaagtaaacaaaattaaaaacgccctactcagtacaaataaagctgtcgtaagtttatcaaacggagtatcagtccttacattcaaagtattagacctaaaaaattatatagacaaacaattactaccaatactcaacaaacaatcatgctcaataccaaatatagaaaccgtaatagaatttcagcaaaaaaataacagattactagaaataaccagagaattttcagtcaacgcaggagtcacaacacccgtctcaacctacatgctaaccaactcagaacttctatctcttatcaacgacatgcccataaccaatgatcaaaaaaaattaatgtctaataacgttcaaatagtaagacaacaatcatactcaataatgtgcataatcaaagaagaagtattagcatacgtagtacaactacccctatatggagtaatagacacaccctgctggaaactacacacatcccccctctgtacaacaaacactaaagaaggatcaaacatttgcctaacaagaacagaccgcggatggtactgcgacaacgcaggctccgtatctttctttccacaagccgaaacttgtaaagttcaatcaaacagagtattttgcgatacaatgaactccttaacattaccttcagaagtaaacctatgcaacatagacatcttcaacccaaaatacgactgcaaaataatgacctcaaaaacagacgtatcctcatcagtcataacctccttaggagcaatagtatcatgttacggaaaaacaaaatgtacagcatcaaataaaaatagaggaataataaaaaccttctccaacggatgcgactacgtatccaataaaggagtagacaccgtatcagtaggaaacacactatactgtgtaaacaaacaagaaggccaatctctatatgtaaaaggcgaaccaatcataaatttttacgacccacttgtcttcccctccgacgaatttgacgcaagcatatcacaagtaaacgaaaaaatcaaccaaagcctagccttcataaggaaatctgacgaattacttcataacgtaaatgttggaaaatcaaccacaaacataatgataaccaccatcataattgtaataatagtaatactactactactaattgcagtaggactcttcctatattgcaaagctcgctcaacaccagttaccttatcaaaagaccaactatctggaataaacaacatagccttttccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14806 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut2 (opt11)
  source 1..1897: mol_type = other RNA
gggagagcggctcggccattttgtcccagtcagtccggaggctgcggctgcagaagtaccgcctgcggagtaactgcaaagaagcttaccatggaactcccaatcctaaaaaccaacgccatcaccaccatcctcgccgctgtcaccttatgctttgccagcagccaaaacatcaccgaagaattttaccaatcaacatgctccgccgtctcaaaaggatacctcggcgccctacgcaccggctggtacacaagcgtcataaccatcgagctctccaacatcaaggaaaacaaatgcaatggaaccgacgccaaagtcaaactaatcaaacaagaactagacaagtacaagaacgcagtcaccgacctccaactcctcatgcagtccacccccgcagcaggctctggctcagcaatatgctccggcatcgctgtctgcaaagtcctacacctcgaaggcgaagtcaacaaaatcaaaaacgccctactgtccacaaacaaagccgtcgtctccctatccaacggcgtctcggtcctaacctttaaggttctcgatctcaaaaattacatagacaaacaactactccccatcctcaacaaacaatcttgctcaatccccaacatcgaaaccgtcatcgagttccaacagaaaaacaacagactactcgaaatcacccgcgagttctcagtcaacgcgggcgtcacaacacccgtcagcacctacatgctaaccaactccgaactcctcagcctcattaacgacatgcccatcaccaacgaccaaaagaaacttatgtccaacaacgttcaaatcgtccgccaacaatcctactccatcatgtgcatcatcaaagaagaagtactcgcctacgtagtccaactgcccctctacggcgtcatcgataccccatgctggaaactacacaccagccccctctgcaccaccaacaccaaagaaggctccaatatctgcttaacccgcacagaccgtggctggtactgcgataacgccggctccgtctccttcttcccccaagcagaaacctgcaaagtacaatccaaccgagtcttctgtgacaccatgaactccctaacccttccatcagaagtcaacctctgcaacatcgacatcttcaaccccaagtacgactgcaaaatcatgacatccaaaaccgatgtctcaagcagcgtcataacctcactcggcgctatcgtaagctgctacggcaaaaccaaatgcaccgcatcaaacaaaaaccgcggaatcatcaaaaccttcagcaacggatgcgactacgtttccaacaaaggcgtagacaccgtctccgtcggaaacaccctctactgcgtaaacaaacaggaaggccaatccctctacgtcaaaggcgaacccatcataaacttctacgatccccttgtcttcccgtccgatgagttcgacgcctccatctcgcaagtcaacgaaaagataaaccaatcactagcattcatccgtaaatccgacgaactcctccacaacgtcaacgtcggaaaatccaccaccaacataatgatcaccaccataatcatcgtcatcatcgtaatactattactcctcatagccgtcggcctcttcctatattgcaaagcccgatcaacccccgtaaccctttctaaagaccaactgtccggaatcaacaacatcgctttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14807 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut2 (opt1)
  source 1..1906: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14808 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut2 (opt1)
  source 1..1906: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14809 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut2 (opt2)
  source 1..1906: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14810 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut2 (opt3)
  source 1..1906: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagatcaactcagtggcattaataacatcgcattctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14811 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut2 (opt4)
  source 1..1906: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14812 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut2 (opt5)
  source 1..1906: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagatcaactctctgggatcaataacattgctttctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14813 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut2 (opt6)
  source 1..1906: mol_type = other RNA
gggagacccgtgacccggaagttgtacggctacgcgactttccctcccacaaaccctcgcgcccttcctttcctacttgggcccggcagaaagcttaccatggagcttccaatattaaaaacaaacgctataacaactatactcgcagcagttacactctgcttcgcatcctcacaaaacataactgaagaattttaccaatccacttgctcagccgtatcaaaaggatatctaggagcacttagaaccggatggtatacatcagtgataacaatagaactaagcaacataaaagaaaacaagtgcaacggaactgacgcaaaagtcaaactaatcaaacaagaactagacaaatacaaaaacgcagtaacagacctacaattactaatgcaatcaacaccagcagcaggatcaggttcagccatatgctcaggtatcgctgtatgcaaagtccttcacctagaaggtgaagtaaacaaaattaaaaacgccctactcagtacaaataaagctgtcgtaagtttatcaaacggagtatcagtccttacattcaaagtattagacctaaaaaattatatagacaaacaattactaccaatactcaacaaacaatcatgctcaataccaaatatagaaaccgtaatagaatttcagcaaaaaaataacagattactagaaataaccagagaattttcagtcaacgcaggagtcacaacacccgtctcaacctacatgctaaccaactcagaacttctatctcttatcaacgacatgcccataaccaatgatcaaaaaaaattaatgtctaataacgttcaaatagtaagacaacaatcatactcaataatgtgcataatcaaagaagaagtattagcatacgtagtacaactacccctatatggagtaatagacacaccctgctggaaactacacacatcccccctctgtacaacaaacactaaagaaggatcaaacatttgcctaacaagaacagaccgcggatggtactgcgacaacgcaggctccgtatctttctttccacaagccgaaacttgtaaagttcaatcaaacagagtattttgcgatacaatgaactccttaacattaccttcagaagtaaacctatgcaacatagacatcttcaacccaaaatacgactgcaaaataatgacctcaaaaacagacgtatcctcatcagtcataacctccttaggagcaatagtatcatgttacggaaaaacaaaatgtacagcatcaaataaaaatagaggaataataaaaaccttctccaacggatgcgactacgtatccaataaaggagtagacaccgtatcagtaggaaacacactatactgtgtaaacaaacaagaaggccaatctctatatgtaaaaggcgaaccaatcataaatttttacgacccacttgtcttcccctccgacgaatttgacgcaagcatatcacaagtaaacgaaaaaatcaaccaaagcctagccttcataaggaaatctgacgaattacttcataacgtaaatgttggaaaatcaaccacaaacataatgataaccaccatcataattgtaataatagtaatactactactactaattgcagtaggactcttcctatattgcaaagctcgctcaacaccagttaccttatcaaaagaccaactatctggaataaacaacatagccttttccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14814 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut2 (opt11)
  source 1..1906: mol_type = other RNA
gggagacccgtgacccggaagttgtacggctacgcgactttccctcccacaaaccctcgcgcccttcctttcctacttgggcccggcagaaagcttaccatggaactcccaatcctaaaaaccaacgccatcaccaccatcctcgccgctgtcaccttatgctttgccagcagccaaaacatcaccgaagaattttaccaatcaacatgctccgccgtctcaaaaggatacctcggcgccctacgcaccggctggtacacaagcgtcataaccatcgagctctccaacatcaaggaaaacaaatgcaatggaaccgacgccaaagtcaaactaatcaaacaagaactagacaagtacaagaacgcagtcaccgacctccaactcctcatgcagtccacccccgcagcaggctctggctcagcaatatgctccggcatcgctgtctgcaaagtcctacacctcgaaggcgaagtcaacaaaatcaaaaacgccctactgtccacaaacaaagccgtcgtctccctatccaacggcgtctcggtcctaacctttaaggttctcgatctcaaaaattacatagacaaacaactactccccatcctcaacaaacaatcttgctcaatccccaacatcgaaaccgtcatcgagttccaacagaaaaacaacagactactcgaaatcacccgcgagttctcagtcaacgcgggcgtcacaacacccgtcagcacctacatgctaaccaactccgaactcctcagcctcattaacgacatgcccatcaccaacgaccaaaagaaacttatgtccaacaacgttcaaatcgtccgccaacaatcctactccatcatgtgcatcatcaaagaagaagtactcgcctacgtagtccaactgcccctctacggcgtcatcgataccccatgctggaaactacacaccagccccctctgcaccaccaacaccaaagaaggctccaatatctgcttaacccgcacagaccgtggctggtactgcgataacgccggctccgtctccttcttcccccaagcagaaacctgcaaagtacaatccaaccgagtcttctgtgacaccatgaactccctaacccttccatcagaagtcaacctctgcaacatcgacatcttcaaccccaagtacgactgcaaaatcatgacatccaaaaccgatgtctcaagcagcgtcataacctcactcggcgctatcgtaagctgctacggcaaaaccaaatgcaccgcatcaaacaaaaaccgcggaatcatcaaaaccttcagcaacggatgcgactacgtttccaacaaaggcgtagacaccgtctccgtcggaaacaccctctactgcgtaaacaaacaggaaggccaatccctctacgtcaaaggcgaacccatcataaacttctacgatccccttgtcttcccgtccgatgagttcgacgcctccatctcgcaagtcaacgaaaagataaaccaatcactagcattcatccgtaaatccgacgaactcctccacaacgtcaacgtcggaaaatccaccaccaacataatgatcaccaccataatcatcgtcatcatcgtaatactattactcctcatagccgtcggcctcttcctatattgcaaagcccgatcaacccccgtaaccctttctaaagaccaactgtccggaatcaacaacatcgctttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14815 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut2 (opt1)
  source 1..1961: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14816 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut2 (opt1)
  source 1..1961: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14817 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut2 (opt2)
  source 1..1961: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14818 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut2 (opt3)
  source 1..1961: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagatcaactcagtggcattaataacatcgcattctctaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14819 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut2 (opt4)
  source 1..1961: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14820 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut2 (opt5)
  source 1..1961: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagatcaactctctgggatcaataacattgctttctccaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14821 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut2 (opt6)
  source 1..1961: mol_type = other RNA
gggagagcggctcggccattttgtcccagtcagtccggaggctgcggctgcagaagtaccgcctgcggagtaactgcaaagaagcttaccatggagcttccaatattaaaaacaaacgctataacaactatactcgcagcagttacactctgcttcgcatcctcacaaaacataactgaagaattttaccaatccacttgctcagccgtatcaaaaggatatctaggagcacttagaaccggatggtatacatcagtgataacaatagaactaagcaacataaaagaaaacaagtgcaacggaactgacgcaaaagtcaaactaatcaaacaagaactagacaaatacaaaaacgcagtaacagacctacaattactaatgcaatcaacaccagcagcaggatcaggttcagccatatgctcaggtatcgctgtatgcaaagtccttcacctagaaggtgaagtaaacaaaattaaaaacgccctactcagtacaaataaagctgtcgtaagtttatcaaacggagtatcagtccttacattcaaagtattagacctaaaaaattatatagacaaacaattactaccaatactcaacaaacaatcatgctcaataccaaatatagaaaccgtaatagaatttcagcaaaaaaataacagattactagaaataaccagagaattttcagtcaacgcaggagtcacaacacccgtctcaacctacatgctaaccaactcagaacttctatctcttatcaacgacatgcccataaccaatgatcaaaaaaaattaatgtctaataacgttcaaatagtaagacaacaatcatactcaataatgtgcataatcaaagaagaagtattagcatacgtagtacaactacccctatatggagtaatagacacaccctgctggaaactacacacatcccccctctgtacaacaaacactaaagaaggatcaaacatttgcctaacaagaacagaccgcggatggtactgcgacaacgcaggctccgtatctttctttccacaagccgaaacttgtaaagttcaatcaaacagagtattttgcgatacaatgaactccttaacattaccttcagaagtaaacctatgcaacatagacatcttcaacccaaaatacgactgcaaaataatgacctcaaaaacagacgtatcctcatcagtcataacctccttaggagcaatagtatcatgttacggaaaaacaaaatgtacagcatcaaataaaaatagaggaataataaaaaccttctccaacggatgcgactacgtatccaataaaggagtagacaccgtatcagtaggaaacacactatactgtgtaaacaaacaagaaggccaatctctatatgtaaaaggcgaaccaatcataaatttttacgacccacttgtcttcccctccgacgaatttgacgcaagcatatcacaagtaaacgaaaaaatcaaccaaagcctagccttcataaggaaatctgacgaattacttcataacgtaaatgttggaaaatcaaccacaaacataatgataaccaccatcataattgtaataatagtaatactactactactaattgcagtaggactcttcctatattgcaaagctcgctcaacaccagttaccttatcaaaagaccaactatctggaataaacaacatagccttttccaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14822 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut2 (opt11)
  source 1..1961: mol_type = other RNA
gggagagcggctcggccattttgtcccagtcagtccggaggctgcggctgcagaagtaccgcctgcggagtaactgcaaagaagcttaccatggaactcccaatcctaaaaaccaacgccatcaccaccatcctcgccgctgtcaccttatgctttgccagcagccaaaacatcaccgaagaattttaccaatcaacatgctccgccgtctcaaaaggatacctcggcgccctacgcaccggctggtacacaagcgtcataaccatcgagctctccaacatcaaggaaaacaaatgcaatggaaccgacgccaaagtcaaactaatcaaacaagaactagacaagtacaagaacgcagtcaccgacctccaactcctcatgcagtccacccccgcagcaggctctggctcagcaatatgctccggcatcgctgtctgcaaagtcctacacctcgaaggcgaagtcaacaaaatcaaaaacgccctactgtccacaaacaaagccgtcgtctccctatccaacggcgtctcggtcctaacctttaaggttctcgatctcaaaaattacatagacaaacaactactccccatcctcaacaaacaatcttgctcaatccccaacatcgaaaccgtcatcgagttccaacagaaaaacaacagactactcgaaatcacccgcgagttctcagtcaacgcgggcgtcacaacacccgtcagcacctacatgctaaccaactccgaactcctcagcctcattaacgacatgcccatcaccaacgaccaaaagaaacttatgtccaacaacgttcaaatcgtccgccaacaatcctactccatcatgtgcatcatcaaagaagaagtactcgcctacgtagtccaactgcccctctacggcgtcatcgataccccatgctggaaactacacaccagccccctctgcaccaccaacaccaaagaaggctccaatatctgcttaacccgcacagaccgtggctggtactgcgataacgccggctccgtctccttcttcccccaagcagaaacctgcaaagtacaatccaaccgagtcttctgtgacaccatgaactccctaacccttccatcagaagtcaacctctgcaacatcgacatcttcaaccccaagtacgactgcaaaatcatgacatccaaaaccgatgtctcaagcagcgtcataacctcactcggcgctatcgtaagctgctacggcaaaaccaaatgcaccgcatcaaacaaaaaccgcggaatcatcaaaaccttcagcaacggatgcgactacgtttccaacaaaggcgtagacaccgtctccgtcggaaacaccctctactgcgtaaacaaacaggaaggccaatccctctacgtcaaaggcgaacccatcataaacttctacgatccccttgtcttcccgtccgatgagttcgacgcctccatctcgcaagtcaacgaaaagataaaccaatcactagcattcatccgtaaatccgacgaactcctccacaacgtcaacgtcggaaaatccaccaccaacataatgatcaccaccataatcatcgtcatcatcgtaatactattactcctcatagccgtcggcctcttcctatattgcaaagcccgatcaacccccgtaaccctttctaaagaccaactgtccggaatcaacaacatcgctttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14823 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut2 (opt1)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14824 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut2 (opt1)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14825 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut2 (opt2)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14826 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut2 (opt3)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagatcaactcagtggcattaataacatcgcattctctaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14827 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut2 (opt4)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14828 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut2 (opt5)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagatcaactctctgggatcaataacattgctttctccaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14829 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut2 (opt6)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagcttccaatattaaaaacaaacgctataacaactatactcgcagcagttacactctgcttcgcatcctcacaaaacataactgaagaattttaccaatccacttgctcagccgtatcaaaaggatatctaggagcacttagaaccggatggtatacatcagtgataacaatagaactaagcaacataaaagaaaacaagtgcaacggaactgacgcaaaagtcaaactaatcaaacaagaactagacaaatacaaaaacgcagtaacagacctacaattactaatgcaatcaacaccagcagcaggatcaggttcagccatatgctcaggtatcgctgtatgcaaagtccttcacctagaaggtgaagtaaacaaaattaaaaacgccctactcagtacaaataaagctgtcgtaagtttatcaaacggagtatcagtccttacattcaaagtattagacctaaaaaattatatagacaaacaattactaccaatactcaacaaacaatcatgctcaataccaaatatagaaaccgtaatagaatttcagcaaaaaaataacagattactagaaataaccagagaattttcagtcaacgcaggagtcacaacacccgtctcaacctacatgctaaccaactcagaacttctatctcttatcaacgacatgcccataaccaatgatcaaaaaaaattaatgtctaataacgttcaaatagtaagacaacaatcatactcaataatgtgcataatcaaagaagaagtattagcatacgtagtacaactacccctatatggagtaatagacacaccctgctggaaactacacacatcccccctctgtacaacaaacactaaagaaggatcaaacatttgcctaacaagaacagaccgcggatggtactgcgacaacgcaggctccgtatctttctttccacaagccgaaacttgtaaagttcaatcaaacagagtattttgcgatacaatgaactccttaacattaccttcagaagtaaacctatgcaacatagacatcttcaacccaaaatacgactgcaaaataatgacctcaaaaacagacgtatcctcatcagtcataacctccttaggagcaatagtatcatgttacggaaaaacaaaatgtacagcatcaaataaaaatagaggaataataaaaaccttctccaacggatgcgactacgtatccaataaaggagtagacaccgtatcagtaggaaacacactatactgtgtaaacaaacaagaaggccaatctctatatgtaaaaggcgaaccaatcataaatttttacgacccacttgtcttcccctccgacgaatttgacgcaagcatatcacaagtaaacgaaaaaatcaaccaaagcctagccttcataaggaaatctgacgaattacttcataacgtaaatgttggaaaatcaaccacaaacataatgataaccaccatcataattgtaataatagtaatactactactactaattgcagtaggactcttcctatattgcaaagctcgctcaacaccagttaccttatcaaaagaccaactatctggaataaacaacatagccttttccaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14830 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut2 (opt11)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccaatcctaaaaaccaacgccatcaccaccatcctcgccgctgtcaccttatgctttgccagcagccaaaacatcaccgaagaattttaccaatcaacatgctccgccgtctcaaaaggatacctcggcgccctacgcaccggctggtacacaagcgtcataaccatcgagctctccaacatcaaggaaaacaaatgcaatggaaccgacgccaaagtcaaactaatcaaacaagaactagacaagtacaagaacgcagtcaccgacctccaactcctcatgcagtccacccccgcagcaggctctggctcagcaatatgctccggcatcgctgtctgcaaagtcctacacctcgaaggcgaagtcaacaaaatcaaaaacgccctactgtccacaaacaaagccgtcgtctccctatccaacggcgtctcggtcctaacctttaaggttctcgatctcaaaaattacatagacaaacaactactccccatcctcaacaaacaatcttgctcaatccccaacatcgaaaccgtcatcgagttccaacagaaaaacaacagactactcgaaatcacccgcgagttctcagtcaacgcgggcgtcacaacacccgtcagcacctacatgctaaccaactccgaactcctcagcctcattaacgacatgcccatcaccaacgaccaaaagaaacttatgtccaacaacgttcaaatcgtccgccaacaatcctactccatcatgtgcatcatcaaagaagaagtactcgcctacgtagtccaactgcccctctacggcgtcatcgataccccatgctggaaactacacaccagccccctctgcaccaccaacaccaaagaaggctccaatatctgcttaacccgcacagaccgtggctggtactgcgataacgccggctccgtctccttcttcccccaagcagaaacctgcaaagtacaatccaaccgagtcttctgtgacaccatgaactccctaacccttccatcagaagtcaacctctgcaacatcgacatcttcaaccccaagtacgactgcaaaatcatgacatccaaaaccgatgtctcaagcagcgtcataacctcactcggcgctatcgtaagctgctacggcaaaaccaaatgcaccgcatcaaacaaaaaccgcggaatcatcaaaaccttcagcaacggatgcgactacgtttccaacaaaggcgtagacaccgtctccgtcggaaacaccctctactgcgtaaacaaacaggaaggccaatccctctacgtcaaaggcgaacccatcataaacttctacgatccccttgtcttcccgtccgatgagttcgacgcctccatctcgcaagtcaacgaaaagataaaccaatcactagcattcatccgtaaatccgacgaactcctccacaacgtcaacgtcggaaaatccaccaccaacataatgatcaccaccataatcatcgtcatcatcgtaatactattactcctcatagccgtcggcctcttcctatattgcaaagcccgatcaacccccgtaaccctttctaaagaccaactgtccggaatcaacaacatcgctttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14831 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut2 (opt1)
  source 1..1960: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14832 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut2 (opt1)
  source 1..1960: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14833 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut2 (opt2)
  source 1..1960: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14834 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut2 (opt3)
  source 1..1960: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagatcaactcagtggcattaataacatcgcattctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14835 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut2 (opt4)
  source 1..1960: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14836 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut2 (opt5)
  source 1..1960: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagatcaactctctgggatcaataacattgctttctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14837 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut2 (opt6)
  source 1..1960: mol_type = other RNA
gggagagtcccgcagtcggcgtccagcggctctgcttgttcgtgtgtgtgtcgttgcaggccttattcaagcttaccatggagcttccaatattaaaaacaaacgctataacaactatactcgcagcagttacactctgcttcgcatcctcacaaaacataactgaagaattttaccaatccacttgctcagccgtatcaaaaggatatctaggagcacttagaaccggatggtatacatcagtgataacaatagaactaagcaacataaaagaaaacaagtgcaacggaactgacgcaaaagtcaaactaatcaaacaagaactagacaaatacaaaaacgcagtaacagacctacaattactaatgcaatcaacaccagcagcaggatcaggttcagccatatgctcaggtatcgctgtatgcaaagtccttcacctagaaggtgaagtaaacaaaattaaaaacgccctactcagtacaaataaagctgtcgtaagtttatcaaacggagtatcagtccttacattcaaagtattagacctaaaaaattatatagacaaacaattactaccaatactcaacaaacaatcatgctcaataccaaatatagaaaccgtaatagaatttcagcaaaaaaataacagattactagaaataaccagagaattttcagtcaacgcaggagtcacaacacccgtctcaacctacatgctaaccaactcagaacttctatctcttatcaacgacatgcccataaccaatgatcaaaaaaaattaatgtctaataacgttcaaatagtaagacaacaatcatactcaataatgtgcataatcaaagaagaagtattagcatacgtagtacaactacccctatatggagtaatagacacaccctgctggaaactacacacatcccccctctgtacaacaaacactaaagaaggatcaaacatttgcctaacaagaacagaccgcggatggtactgcgacaacgcaggctccgtatctttctttccacaagccgaaacttgtaaagttcaatcaaacagagtattttgcgatacaatgaactccttaacattaccttcagaagtaaacctatgcaacatagacatcttcaacccaaaatacgactgcaaaataatgacctcaaaaacagacgtatcctcatcagtcataacctccttaggagcaatagtatcatgttacggaaaaacaaaatgtacagcatcaaataaaaatagaggaataataaaaaccttctccaacggatgcgactacgtatccaataaaggagtagacaccgtatcagtaggaaacacactatactgtgtaaacaaacaagaaggccaatctctatatgtaaaaggcgaaccaatcataaatttttacgacccacttgtcttcccctccgacgaatttgacgcaagcatatcacaagtaaacgaaaaaatcaaccaaagcctagccttcataaggaaatctgacgaattacttcataacgtaaatgttggaaaatcaaccacaaacataatgataaccaccatcataattgtaataatagtaatactactactactaattgcagtaggactcttcctatattgcaaagctcgctcaacaccagttaccttatcaaaagaccaactatctggaataaacaacatagccttttccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14838 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut2 (opt11)
  source 1..1960: mol_type = other RNA
gggagagtcccgcagtcggcgtccagcggctctgcttgttcgtgtgtgtgtcgttgcaggccttattcaagcttaccatggaactcccaatcctaaaaaccaacgccatcaccaccatcctcgccgctgtcaccttatgctttgccagcagccaaaacatcaccgaagaattttaccaatcaacatgctccgccgtctcaaaaggatacctcggcgccctacgcaccggctggtacacaagcgtcataaccatcgagctctccaacatcaaggaaaacaaatgcaatggaaccgacgccaaagtcaaactaatcaaacaagaactagacaagtacaagaacgcagtcaccgacctccaactcctcatgcagtccacccccgcagcaggctctggctcagcaatatgctccggcatcgctgtctgcaaagtcctacacctcgaaggcgaagtcaacaaaatcaaaaacgccctactgtccacaaacaaagccgtcgtctccctatccaacggcgtctcggtcctaacctttaaggttctcgatctcaaaaattacatagacaaacaactactccccatcctcaacaaacaatcttgctcaatccccaacatcgaaaccgtcatcgagttccaacagaaaaacaacagactactcgaaatcacccgcgagttctcagtcaacgcgggcgtcacaacacccgtcagcacctacatgctaaccaactccgaactcctcagcctcattaacgacatgcccatcaccaacgaccaaaagaaacttatgtccaacaacgttcaaatcgtccgccaacaatcctactccatcatgtgcatcatcaaagaagaagtactcgcctacgtagtccaactgcccctctacggcgtcatcgataccccatgctggaaactacacaccagccccctctgcaccaccaacaccaaagaaggctccaatatctgcttaacccgcacagaccgtggctggtactgcgataacgccggctccgtctccttcttcccccaagcagaaacctgcaaagtacaatccaaccgagtcttctgtgacaccatgaactccctaacccttccatcagaagtcaacctctgcaacatcgacatcttcaaccccaagtacgactgcaaaatcatgacatccaaaaccgatgtctcaagcagcgtcataacctcactcggcgctatcgtaagctgctacggcaaaaccaaatgcaccgcatcaaacaaaaaccgcggaatcatcaaaaccttcagcaacggatgcgactacgtttccaacaaaggcgtagacaccgtctccgtcggaaacaccctctactgcgtaaacaaacaggaaggccaatccctctacgtcaaaggcgaacccatcataaacttctacgatccccttgtcttcccgtccgatgagttcgacgcctccatctcgcaagtcaacgaaaagataaaccaatcactagcattcatccgtaaatccgacgaactcctccacaacgtcaacgtcggaaaatccaccaccaacataatgatcaccaccataatcatcgtcatcatcgtaatactattactcctcatagccgtcggcctcttcctatattgcaaagcccgatcaacccccgtaaccctttctaaagaccaactgtccggaatcaacaacatcgctttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14839 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut2 (opt1)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14840 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut2 (opt1)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14841 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut2 (opt2)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14842 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut2 (opt3)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagatcaactcagtggcattaataacatcgcattctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14843 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut2 (opt4)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14844 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut2 (opt5)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagatcaactctctgggatcaataacattgctttctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14845 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut2 (opt6)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagcttccaatattaaaaacaaacgctataacaactatactcgcagcagttacactctgcttcgcatcctcacaaaacataactgaagaattttaccaatccacttgctcagccgtatcaaaaggatatctaggagcacttagaaccggatggtatacatcagtgataacaatagaactaagcaacataaaagaaaacaagtgcaacggaactgacgcaaaagtcaaactaatcaaacaagaactagacaaatacaaaaacgcagtaacagacctacaattactaatgcaatcaacaccagcagcaggatcaggttcagccatatgctcaggtatcgctgtatgcaaagtccttcacctagaaggtgaagtaaacaaaattaaaaacgccctactcagtacaaataaagctgtcgtaagtttatcaaacggagtatcagtccttacattcaaagtattagacctaaaaaattatatagacaaacaattactaccaatactcaacaaacaatcatgctcaataccaaatatagaaaccgtaatagaatttcagcaaaaaaataacagattactagaaataaccagagaattttcagtcaacgcaggagtcacaacacccgtctcaacctacatgctaaccaactcagaacttctatctcttatcaacgacatgcccataaccaatgatcaaaaaaaattaatgtctaataacgttcaaatagtaagacaacaatcatactcaataatgtgcataatcaaagaagaagtattagcatacgtagtacaactacccctatatggagtaatagacacaccctgctggaaactacacacatcccccctctgtacaacaaacactaaagaaggatcaaacatttgcctaacaagaacagaccgcggatggtactgcgacaacgcaggctccgtatctttctttccacaagccgaaacttgtaaagttcaatcaaacagagtattttgcgatacaatgaactccttaacattaccttcagaagtaaacctatgcaacatagacatcttcaacccaaaatacgactgcaaaataatgacctcaaaaacagacgtatcctcatcagtcataacctccttaggagcaatagtatcatgttacggaaaaacaaaatgtacagcatcaaataaaaatagaggaataataaaaaccttctccaacggatgcgactacgtatccaataaaggagtagacaccgtatcagtaggaaacacactatactgtgtaaacaaacaagaaggccaatctctatatgtaaaaggcgaaccaatcataaatttttacgacccacttgtcttcccctccgacgaatttgacgcaagcatatcacaagtaaacgaaaaaatcaaccaaagcctagccttcataaggaaatctgacgaattacttcataacgtaaatgttggaaaatcaaccacaaacataatgataaccaccatcataattgtaataatagtaatactactactactaattgcagtaggactcttcctatattgcaaagctcgctcaacaccagttaccttatcaaaagaccaactatctggaataaacaacatagccttttccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14846 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut2 (opt11)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccaatcctaaaaaccaacgccatcaccaccatcctcgccgctgtcaccttatgctttgccagcagccaaaacatcaccgaagaattttaccaatcaacatgctccgccgtctcaaaaggatacctcggcgccctacgcaccggctggtacacaagcgtcataaccatcgagctctccaacatcaaggaaaacaaatgcaatggaaccgacgccaaagtcaaactaatcaaacaagaactagacaagtacaagaacgcagtcaccgacctccaactcctcatgcagtccacccccgcagcaggctctggctcagcaatatgctccggcatcgctgtctgcaaagtcctacacctcgaaggcgaagtcaacaaaatcaaaaacgccctactgtccacaaacaaagccgtcgtctccctatccaacggcgtctcggtcctaacctttaaggttctcgatctcaaaaattacatagacaaacaactactccccatcctcaacaaacaatcttgctcaatccccaacatcgaaaccgtcatcgagttccaacagaaaaacaacagactactcgaaatcacccgcgagttctcagtcaacgcgggcgtcacaacacccgtcagcacctacatgctaaccaactccgaactcctcagcctcattaacgacatgcccatcaccaacgaccaaaagaaacttatgtccaacaacgttcaaatcgtccgccaacaatcctactccatcatgtgcatcatcaaagaagaagtactcgcctacgtagtccaactgcccctctacggcgtcatcgataccccatgctggaaactacacaccagccccctctgcaccaccaacaccaaagaaggctccaatatctgcttaacccgcacagaccgtggctggtactgcgataacgccggctccgtctccttcttcccccaagcagaaacctgcaaagtacaatccaaccgagtcttctgtgacaccatgaactccctaacccttccatcagaagtcaacctctgcaacatcgacatcttcaaccccaagtacgactgcaaaatcatgacatccaaaaccgatgtctcaagcagcgtcataacctcactcggcgctatcgtaagctgctacggcaaaaccaaatgcaccgcatcaaacaaaaaccgcggaatcatcaaaaccttcagcaacggatgcgactacgtttccaacaaaggcgtagacaccgtctccgtcggaaacaccctctactgcgtaaacaaacaggaaggccaatccctctacgtcaaaggcgaacccatcataaacttctacgatccccttgtcttcccgtccgatgagttcgacgcctccatctcgcaagtcaacgaaaagataaaccaatcactagcattcatccgtaaatccgacgaactcctccacaacgtcaacgtcggaaaatccaccaccaacataatgatcaccaccataatcatcgtcatcatcgtaatactattactcctcatagccgtcggcctcttcctatattgcaaagcccgatcaacccccgtaaccctttctaaagaccaactgtccggaatcaacaacatcgctttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14847 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut2 (opt1)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14848 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut2 (opt1)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14849 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut2 (opt2)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14850 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut2 (opt3)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagatcaactcagtggcattaataacatcgcattctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14851 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut2 (opt4)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14852 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut2 (opt5)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagatcaactctctgggatcaataacattgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14853 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut2 (opt6)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagcttccaatattaaaaacaaacgctataacaactatactcgcagcagttacactctgcttcgcatcctcacaaaacataactgaagaattttaccaatccacttgctcagccgtatcaaaaggatatctaggagcacttagaaccggatggtatacatcagtgataacaatagaactaagcaacataaaagaaaacaagtgcaacggaactgacgcaaaagtcaaactaatcaaacaagaactagacaaatacaaaaacgcagtaacagacctacaattactaatgcaatcaacaccagcagcaggatcaggttcagccatatgctcaggtatcgctgtatgcaaagtccttcacctagaaggtgaagtaaacaaaattaaaaacgccctactcagtacaaataaagctgtcgtaagtttatcaaacggagtatcagtccttacattcaaagtattagacctaaaaaattatatagacaaacaattactaccaatactcaacaaacaatcatgctcaataccaaatatagaaaccgtaatagaatttcagcaaaaaaataacagattactagaaataaccagagaattttcagtcaacgcaggagtcacaacacccgtctcaacctacatgctaaccaactcagaacttctatctcttatcaacgacatgcccataaccaatgatcaaaaaaaattaatgtctaataacgttcaaatagtaagacaacaatcatactcaataatgtgcataatcaaagaagaagtattagcatacgtagtacaactacccctatatggagtaatagacacaccctgctggaaactacacacatcccccctctgtacaacaaacactaaagaaggatcaaacatttgcctaacaagaacagaccgcggatggtactgcgacaacgcaggctccgtatctttctttccacaagccgaaacttgtaaagttcaatcaaacagagtattttgcgatacaatgaactccttaacattaccttcagaagtaaacctatgcaacatagacatcttcaacccaaaatacgactgcaaaataatgacctcaaaaacagacgtatcctcatcagtcataacctccttaggagcaatagtatcatgttacggaaaaacaaaatgtacagcatcaaataaaaatagaggaataataaaaaccttctccaacggatgcgactacgtatccaataaaggagtagacaccgtatcagtaggaaacacactatactgtgtaaacaaacaagaaggccaatctctatatgtaaaaggcgaaccaatcataaatttttacgacccacttgtcttcccctccgacgaatttgacgcaagcatatcacaagtaaacgaaaaaatcaaccaaagcctagccttcataaggaaatctgacgaattacttcataacgtaaatgttggaaaatcaaccacaaacataatgataaccaccatcataattgtaataatagtaatactactactactaattgcagtaggactcttcctatattgcaaagctcgctcaacaccagttaccttatcaaaagaccaactatctggaataaacaacatagccttttccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14854 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut2 (opt11)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactcccaatcctaaaaaccaacgccatcaccaccatcctcgccgctgtcaccttatgctttgccagcagccaaaacatcaccgaagaattttaccaatcaacatgctccgccgtctcaaaaggatacctcggcgccctacgcaccggctggtacacaagcgtcataaccatcgagctctccaacatcaaggaaaacaaatgcaatggaaccgacgccaaagtcaaactaatcaaacaagaactagacaagtacaagaacgcagtcaccgacctccaactcctcatgcagtccacccccgcagcaggctctggctcagcaatatgctccggcatcgctgtctgcaaagtcctacacctcgaaggcgaagtcaacaaaatcaaaaacgccctactgtccacaaacaaagccgtcgtctccctatccaacggcgtctcggtcctaacctttaaggttctcgatctcaaaaattacatagacaaacaactactccccatcctcaacaaacaatcttgctcaatccccaacatcgaaaccgtcatcgagttccaacagaaaaacaacagactactcgaaatcacccgcgagttctcagtcaacgcgggcgtcacaacacccgtcagcacctacatgctaaccaactccgaactcctcagcctcattaacgacatgcccatcaccaacgaccaaaagaaacttatgtccaacaacgttcaaatcgtccgccaacaatcctactccatcatgtgcatcatcaaagaagaagtactcgcctacgtagtccaactgcccctctacggcgtcatcgataccccatgctggaaactacacaccagccccctctgcaccaccaacaccaaagaaggctccaatatctgcttaacccgcacagaccgtggctggtactgcgataacgccggctccgtctccttcttcccccaagcagaaacctgcaaagtacaatccaaccgagtcttctgtgacaccatgaactccctaacccttccatcagaagtcaacctctgcaacatcgacatcttcaaccccaagtacgactgcaaaatcatgacatccaaaaccgatgtctcaagcagcgtcataacctcactcggcgctatcgtaagctgctacggcaaaaccaaatgcaccgcatcaaacaaaaaccgcggaatcatcaaaaccttcagcaacggatgcgactacgtttccaacaaaggcgtagacaccgtctccgtcggaaacaccctctactgcgtaaacaaacaggaaggccaatccctctacgtcaaaggcgaacccatcataaacttctacgatccccttgtcttcccgtccgatgagttcgacgcctccatctcgcaagtcaacgaaaagataaaccaatcactagcattcatccgtaaatccgacgaactcctccacaacgtcaacgtcggaaaatccaccaccaacataatgatcaccaccataatcatcgtcatcatcgtaatactattactcctcatagccgtcggcctcttcctatattgcaaagcccgatcaacccccgtaaccctttctaaagaccaactgtccggaatcaacaacatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14855 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut2 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14856 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut2 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14857 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut2 (opt2)
  source 1..1919: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14858 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut2 (opt3)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagatcaactcagtggcattaataacatcgcattctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14859 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut2 (opt4)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14860 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut2 (opt5)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagatcaactctctgggatcaataacattgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14861 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut2 (opt6)
  source 1..1919: mol_type = other RNA
gggagacccgtgacccggaagttgtacggctacgcgactttccctcccacaaaccctcgcgcccttcctttcctacttgggcccggcagaaagcttaccatggagcttccaatattaaaaacaaacgctataacaactatactcgcagcagttacactctgcttcgcatcctcacaaaacataactgaagaattttaccaatccacttgctcagccgtatcaaaaggatatctaggagcacttagaaccggatggtatacatcagtgataacaatagaactaagcaacataaaagaaaacaagtgcaacggaactgacgcaaaagtcaaactaatcaaacaagaactagacaaatacaaaaacgcagtaacagacctacaattactaatgcaatcaacaccagcagcaggatcaggttcagccatatgctcaggtatcgctgtatgcaaagtccttcacctagaaggtgaagtaaacaaaattaaaaacgccctactcagtacaaataaagctgtcgtaagtttatcaaacggagtatcagtccttacattcaaagtattagacctaaaaaattatatagacaaacaattactaccaatactcaacaaacaatcatgctcaataccaaatatagaaaccgtaatagaatttcagcaaaaaaataacagattactagaaataaccagagaattttcagtcaacgcaggagtcacaacacccgtctcaacctacatgctaaccaactcagaacttctatctcttatcaacgacatgcccataaccaatgatcaaaaaaaattaatgtctaataacgttcaaatagtaagacaacaatcatactcaataatgtgcataatcaaagaagaagtattagcatacgtagtacaactacccctatatggagtaatagacacaccctgctggaaactacacacatcccccctctgtacaacaaacactaaagaaggatcaaacatttgcctaacaagaacagaccgcggatggtactgcgacaacgcaggctccgtatctttctttccacaagccgaaacttgtaaagttcaatcaaacagagtattttgcgatacaatgaactccttaacattaccttcagaagtaaacctatgcaacatagacatcttcaacccaaaatacgactgcaaaataatgacctcaaaaacagacgtatcctcatcagtcataacctccttaggagcaatagtatcatgttacggaaaaacaaaatgtacagcatcaaataaaaatagaggaataataaaaaccttctccaacggatgcgactacgtatccaataaaggagtagacaccgtatcagtaggaaacacactatactgtgtaaacaaacaagaaggccaatctctatatgtaaaaggcgaaccaatcataaatttttacgacccacttgtcttcccctccgacgaatttgacgcaagcatatcacaagtaaacgaaaaaatcaaccaaagcctagccttcataaggaaatctgacgaattacttcataacgtaaatgttggaaaatcaaccacaaacataatgataaccaccatcataattgtaataatagtaatactactactactaattgcagtaggactcttcctatattgcaaagctcgctcaacaccagttaccttatcaaaagaccaactatctggaataaacaacatagccttttccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14862 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut2 (opt11)
  source 1..1919: mol_type = other RNA
gggagacccgtgacccggaagttgtacggctacgcgactttccctcccacaaaccctcgcgcccttcctttcctacttgggcccggcagaaagcttaccatggaactcccaatcctaaaaaccaacgccatcaccaccatcctcgccgctgtcaccttatgctttgccagcagccaaaacatcaccgaagaattttaccaatcaacatgctccgccgtctcaaaaggatacctcggcgccctacgcaccggctggtacacaagcgtcataaccatcgagctctccaacatcaaggaaaacaaatgcaatggaaccgacgccaaagtcaaactaatcaaacaagaactagacaagtacaagaacgcagtcaccgacctccaactcctcatgcagtccacccccgcagcaggctctggctcagcaatatgctccggcatcgctgtctgcaaagtcctacacctcgaaggcgaagtcaacaaaatcaaaaacgccctactgtccacaaacaaagccgtcgtctccctatccaacggcgtctcggtcctaacctttaaggttctcgatctcaaaaattacatagacaaacaactactccccatcctcaacaaacaatcttgctcaatccccaacatcgaaaccgtcatcgagttccaacagaaaaacaacagactactcgaaatcacccgcgagttctcagtcaacgcgggcgtcacaacacccgtcagcacctacatgctaaccaactccgaactcctcagcctcattaacgacatgcccatcaccaacgaccaaaagaaacttatgtccaacaacgttcaaatcgtccgccaacaatcctactccatcatgtgcatcatcaaagaagaagtactcgcctacgtagtccaactgcccctctacggcgtcatcgataccccatgctggaaactacacaccagccccctctgcaccaccaacaccaaagaaggctccaatatctgcttaacccgcacagaccgtggctggtactgcgataacgccggctccgtctccttcttcccccaagcagaaacctgcaaagtacaatccaaccgagtcttctgtgacaccatgaactccctaacccttccatcagaagtcaacctctgcaacatcgacatcttcaaccccaagtacgactgcaaaatcatgacatccaaaaccgatgtctcaagcagcgtcataacctcactcggcgctatcgtaagctgctacggcaaaaccaaatgcaccgcatcaaacaaaaaccgcggaatcatcaaaaccttcagcaacggatgcgactacgtttccaacaaaggcgtagacaccgtctccgtcggaaacaccctctactgcgtaaacaaacaggaaggccaatccctctacgtcaaaggcgaacccatcataaacttctacgatccccttgtcttcccgtccgatgagttcgacgcctccatctcgcaagtcaacgaaaagataaaccaatcactagcattcatccgtaaatccgacgaactcctccacaacgtcaacgtcggaaaatccaccaccaacataatgatcaccaccataatcatcgtcatcatcgtaatactattactcctcatagccgtcggcctcttcctatattgcaaagcccgatcaacccccgtaaccctttctaaagaccaactgtccggaatcaacaacatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14863 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut2 (opt1)
  source 1..1889: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14864 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut2 (opt1)
  source 1..1889: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14865 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut2 (opt2)
  source 1..1889: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14866 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut2 (opt3)
  source 1..1889: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagatcaactcagtggcattaataacatcgcattctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14867 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut2 (opt4)
  source 1..1889: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14868 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut2 (opt5)
  source 1..1889: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagatcaactctctgggatcaataacattgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14869 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut2 (opt6)
  source 1..1889: mol_type = other RNA
gggagactttcccattctgtagcagaatttggtgttgcctgtggtcttggtcccgcggagaagcttaccatggagcttccaatattaaaaacaaacgctataacaactatactcgcagcagttacactctgcttcgcatcctcacaaaacataactgaagaattttaccaatccacttgctcagccgtatcaaaaggatatctaggagcacttagaaccggatggtatacatcagtgataacaatagaactaagcaacataaaagaaaacaagtgcaacggaactgacgcaaaagtcaaactaatcaaacaagaactagacaaatacaaaaacgcagtaacagacctacaattactaatgcaatcaacaccagcagcaggatcaggttcagccatatgctcaggtatcgctgtatgcaaagtccttcacctagaaggtgaagtaaacaaaattaaaaacgccctactcagtacaaataaagctgtcgtaagtttatcaaacggagtatcagtccttacattcaaagtattagacctaaaaaattatatagacaaacaattactaccaatactcaacaaacaatcatgctcaataccaaatatagaaaccgtaatagaatttcagcaaaaaaataacagattactagaaataaccagagaattttcagtcaacgcaggagtcacaacacccgtctcaacctacatgctaaccaactcagaacttctatctcttatcaacgacatgcccataaccaatgatcaaaaaaaattaatgtctaataacgttcaaatagtaagacaacaatcatactcaataatgtgcataatcaaagaagaagtattagcatacgtagtacaactacccctatatggagtaatagacacaccctgctggaaactacacacatcccccctctgtacaacaaacactaaagaaggatcaaacatttgcctaacaagaacagaccgcggatggtactgcgacaacgcaggctccgtatctttctttccacaagccgaaacttgtaaagttcaatcaaacagagtattttgcgatacaatgaactccttaacattaccttcagaagtaaacctatgcaacatagacatcttcaacccaaaatacgactgcaaaataatgacctcaaaaacagacgtatcctcatcagtcataacctccttaggagcaatagtatcatgttacggaaaaacaaaatgtacagcatcaaataaaaatagaggaataataaaaaccttctccaacggatgcgactacgtatccaataaaggagtagacaccgtatcagtaggaaacacactatactgtgtaaacaaacaagaaggccaatctctatatgtaaaaggcgaaccaatcataaatttttacgacccacttgtcttcccctccgacgaatttgacgcaagcatatcacaagtaaacgaaaaaatcaaccaaagcctagccttcataaggaaatctgacgaattacttcataacgtaaatgttggaaaatcaaccacaaacataatgataaccaccatcataattgtaataatagtaatactactactactaattgcagtaggactcttcctatattgcaaagctcgctcaacaccagttaccttatcaaaagaccaactatctggaataaacaacatagccttttccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14870 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut2 (opt11)
  source 1..1889: mol_type = other RNA
gggagactttcccattctgtagcagaatttggtgttgcctgtggtcttggtcccgcggagaagcttaccatggaactcccaatcctaaaaaccaacgccatcaccaccatcctcgccgctgtcaccttatgctttgccagcagccaaaacatcaccgaagaattttaccaatcaacatgctccgccgtctcaaaaggatacctcggcgccctacgcaccggctggtacacaagcgtcataaccatcgagctctccaacatcaaggaaaacaaatgcaatggaaccgacgccaaagtcaaactaatcaaacaagaactagacaagtacaagaacgcagtcaccgacctccaactcctcatgcagtccacccccgcagcaggctctggctcagcaatatgctccggcatcgctgtctgcaaagtcctacacctcgaaggcgaagtcaacaaaatcaaaaacgccctactgtccacaaacaaagccgtcgtctccctatccaacggcgtctcggtcctaacctttaaggttctcgatctcaaaaattacatagacaaacaactactccccatcctcaacaaacaatcttgctcaatccccaacatcgaaaccgtcatcgagttccaacagaaaaacaacagactactcgaaatcacccgcgagttctcagtcaacgcgggcgtcacaacacccgtcagcacctacatgctaaccaactccgaactcctcagcctcattaacgacatgcccatcaccaacgaccaaaagaaacttatgtccaacaacgttcaaatcgtccgccaacaatcctactccatcatgtgcatcatcaaagaagaagtactcgcctacgtagtccaactgcccctctacggcgtcatcgataccccatgctggaaactacacaccagccccctctgcaccaccaacaccaaagaaggctccaatatctgcttaacccgcacagaccgtggctggtactgcgataacgccggctccgtctccttcttcccccaagcagaaacctgcaaagtacaatccaaccgagtcttctgtgacaccatgaactccctaacccttccatcagaagtcaacctctgcaacatcgacatcttcaaccccaagtacgactgcaaaatcatgacatccaaaaccgatgtctcaagcagcgtcataacctcactcggcgctatcgtaagctgctacggcaaaaccaaatgcaccgcatcaaacaaaaaccgcggaatcatcaaaaccttcagcaacggatgcgactacgtttccaacaaaggcgtagacaccgtctccgtcggaaacaccctctactgcgtaaacaaacaggaaggccaatccctctacgtcaaaggcgaacccatcataaacttctacgatccccttgtcttcccgtccgatgagttcgacgcctccatctcgcaagtcaacgaaaagataaaccaatcactagcattcatccgtaaatccgacgaactcctccacaacgtcaacgtcggaaaatccaccaccaacataatgatcaccaccataatcatcgtcatcatcgtaatactattactcctcatagccgtcggcctcttcctatattgcaaagcccgatcaacccccgtaaccctttctaaagaccaactgtccggaatcaacaacatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14871 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut2 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14872 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut2 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14873 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut2 (opt2)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14874 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut2 (opt3)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagatcaactcagtggcattaataacatcgcattctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14875 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut2 (opt4)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14876 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut2 (opt5)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagatcaactctctgggatcaataacattgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14877 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut2 (opt6)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagcttccaatattaaaaacaaacgctataacaactatactcgcagcagttacactctgcttcgcatcctcacaaaacataactgaagaattttaccaatccacttgctcagccgtatcaaaaggatatctaggagcacttagaaccggatggtatacatcagtgataacaatagaactaagcaacataaaagaaaacaagtgcaacggaactgacgcaaaagtcaaactaatcaaacaagaactagacaaatacaaaaacgcagtaacagacctacaattactaatgcaatcaacaccagcagcaggatcaggttcagccatatgctcaggtatcgctgtatgcaaagtccttcacctagaaggtgaagtaaacaaaattaaaaacgccctactcagtacaaataaagctgtcgtaagtttatcaaacggagtatcagtccttacattcaaagtattagacctaaaaaattatatagacaaacaattactaccaatactcaacaaacaatcatgctcaataccaaatatagaaaccgtaatagaatttcagcaaaaaaataacagattactagaaataaccagagaattttcagtcaacgcaggagtcacaacacccgtctcaacctacatgctaaccaactcagaacttctatctcttatcaacgacatgcccataaccaatgatcaaaaaaaattaatgtctaataacgttcaaatagtaagacaacaatcatactcaataatgtgcataatcaaagaagaagtattagcatacgtagtacaactacccctatatggagtaatagacacaccctgctggaaactacacacatcccccctctgtacaacaaacactaaagaaggatcaaacatttgcctaacaagaacagaccgcggatggtactgcgacaacgcaggctccgtatctttctttccacaagccgaaacttgtaaagttcaatcaaacagagtattttgcgatacaatgaactccttaacattaccttcagaagtaaacctatgcaacatagacatcttcaacccaaaatacgactgcaaaataatgacctcaaaaacagacgtatcctcatcagtcataacctccttaggagcaatagtatcatgttacggaaaaacaaaatgtacagcatcaaataaaaatagaggaataataaaaaccttctccaacggatgcgactacgtatccaataaaggagtagacaccgtatcagtaggaaacacactatactgtgtaaacaaacaagaaggccaatctctatatgtaaaaggcgaaccaatcataaatttttacgacccacttgtcttcccctccgacgaatttgacgcaagcatatcacaagtaaacgaaaaaatcaaccaaagcctagccttcataaggaaatctgacgaattacttcataacgtaaatgttggaaaatcaaccacaaacataatgataaccaccatcataattgtaataatagtaatactactactactaattgcagtaggactcttcctatattgcaaagctcgctcaacaccagttaccttatcaaaagaccaactatctggaataaacaacatagccttttccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14878 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut2 (opt11)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcccaatcctaaaaaccaacgccatcaccaccatcctcgccgctgtcaccttatgctttgccagcagccaaaacatcaccgaagaattttaccaatcaacatgctccgccgtctcaaaaggatacctcggcgccctacgcaccggctggtacacaagcgtcataaccatcgagctctccaacatcaaggaaaacaaatgcaatggaaccgacgccaaagtcaaactaatcaaacaagaactagacaagtacaagaacgcagtcaccgacctccaactcctcatgcagtccacccccgcagcaggctctggctcagcaatatgctccggcatcgctgtctgcaaagtcctacacctcgaaggcgaagtcaacaaaatcaaaaacgccctactgtccacaaacaaagccgtcgtctccctatccaacggcgtctcggtcctaacctttaaggttctcgatctcaaaaattacatagacaaacaactactccccatcctcaacaaacaatcttgctcaatccccaacatcgaaaccgtcatcgagttccaacagaaaaacaacagactactcgaaatcacccgcgagttctcagtcaacgcgggcgtcacaacacccgtcagcacctacatgctaaccaactccgaactcctcagcctcattaacgacatgcccatcaccaacgaccaaaagaaacttatgtccaacaacgttcaaatcgtccgccaacaatcctactccatcatgtgcatcatcaaagaagaagtactcgcctacgtagtccaactgcccctctacggcgtcatcgataccccatgctggaaactacacaccagccccctctgcaccaccaacaccaaagaaggctccaatatctgcttaacccgcacagaccgtggctggtactgcgataacgccggctccgtctccttcttcccccaagcagaaacctgcaaagtacaatccaaccgagtcttctgtgacaccatgaactccctaacccttccatcagaagtcaacctctgcaacatcgacatcttcaaccccaagtacgactgcaaaatcatgacatccaaaaccgatgtctcaagcagcgtcataacctcactcggcgctatcgtaagctgctacggcaaaaccaaatgcaccgcatcaaacaaaaaccgcggaatcatcaaaaccttcagcaacggatgcgactacgtttccaacaaaggcgtagacaccgtctccgtcggaaacaccctctactgcgtaaacaaacaggaaggccaatccctctacgtcaaaggcgaacccatcataaacttctacgatccccttgtcttcccgtccgatgagttcgacgcctccatctcgcaagtcaacgaaaagataaaccaatcactagcattcatccgtaaatccgacgaactcctccacaacgtcaacgtcggaaaatccaccaccaacataatgatcaccaccataatcatcgtcatcatcgtaatactattactcctcatagccgtcggcctcttcctatattgcaaagcccgatcaacccccgtaaccctttctaaagaccaactgtccggaatcaacaacatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14879 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut2 (opt1)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14880 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut2 (opt1)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14881 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut2 (opt2)
  source 1..1910: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14882 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut2 (opt3)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagatcaactcagtggcattaataacatcgcattctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14883 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut2 (opt4)
  source 1..1910: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14884 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut2 (opt5)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagatcaactctctgggatcaataacattgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14885 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut2 (opt6)
  source 1..1910: mol_type = other RNA
gggagagcggctcggccattttgtcccagtcagtccggaggctgcggctgcagaagtaccgcctgcggagtaactgcaaagaagcttaccatggagcttccaatattaaaaacaaacgctataacaactatactcgcagcagttacactctgcttcgcatcctcacaaaacataactgaagaattttaccaatccacttgctcagccgtatcaaaaggatatctaggagcacttagaaccggatggtatacatcagtgataacaatagaactaagcaacataaaagaaaacaagtgcaacggaactgacgcaaaagtcaaactaatcaaacaagaactagacaaatacaaaaacgcagtaacagacctacaattactaatgcaatcaacaccagcagcaggatcaggttcagccatatgctcaggtatcgctgtatgcaaagtccttcacctagaaggtgaagtaaacaaaattaaaaacgccctactcagtacaaataaagctgtcgtaagtttatcaaacggagtatcagtccttacattcaaagtattagacctaaaaaattatatagacaaacaattactaccaatactcaacaaacaatcatgctcaataccaaatatagaaaccgtaatagaatttcagcaaaaaaataacagattactagaaataaccagagaattttcagtcaacgcaggagtcacaacacccgtctcaacctacatgctaaccaactcagaacttctatctcttatcaacgacatgcccataaccaatgatcaaaaaaaattaatgtctaataacgttcaaatagtaagacaacaatcatactcaataatgtgcataatcaaagaagaagtattagcatacgtagtacaactacccctatatggagtaatagacacaccctgctggaaactacacacatcccccctctgtacaacaaacactaaagaaggatcaaacatttgcctaacaagaacagaccgcggatggtactgcgacaacgcaggctccgtatctttctttccacaagccgaaacttgtaaagttcaatcaaacagagtattttgcgatacaatgaactccttaacattaccttcagaagtaaacctatgcaacatagacatcttcaacccaaaatacgactgcaaaataatgacctcaaaaacagacgtatcctcatcagtcataacctccttaggagcaatagtatcatgttacggaaaaacaaaatgtacagcatcaaataaaaatagaggaataataaaaaccttctccaacggatgcgactacgtatccaataaaggagtagacaccgtatcagtaggaaacacactatactgtgtaaacaaacaagaaggccaatctctatatgtaaaaggcgaaccaatcataaatttttacgacccacttgtcttcccctccgacgaatttgacgcaagcatatcacaagtaaacgaaaaaatcaaccaaagcctagccttcataaggaaatctgacgaattacttcataacgtaaatgttggaaaatcaaccacaaacataatgataaccaccatcataattgtaataatagtaatactactactactaattgcagtaggactcttcctatattgcaaagctcgctcaacaccagttaccttatcaaaagaccaactatctggaataaacaacatagccttttccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14886 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut2 (opt11)
  source 1..1910: mol_type = other RNA
gggagagcggctcggccattttgtcccagtcagtccggaggctgcggctgcagaagtaccgcctgcggagtaactgcaaagaagcttaccatggaactcccaatcctaaaaaccaacgccatcaccaccatcctcgccgctgtcaccttatgctttgccagcagccaaaacatcaccgaagaattttaccaatcaacatgctccgccgtctcaaaaggatacctcggcgccctacgcaccggctggtacacaagcgtcataaccatcgagctctccaacatcaaggaaaacaaatgcaatggaaccgacgccaaagtcaaactaatcaaacaagaactagacaagtacaagaacgcagtcaccgacctccaactcctcatgcagtccacccccgcagcaggctctggctcagcaatatgctccggcatcgctgtctgcaaagtcctacacctcgaaggcgaagtcaacaaaatcaaaaacgccctactgtccacaaacaaagccgtcgtctccctatccaacggcgtctcggtcctaacctttaaggttctcgatctcaaaaattacatagacaaacaactactccccatcctcaacaaacaatcttgctcaatccccaacatcgaaaccgtcatcgagttccaacagaaaaacaacagactactcgaaatcacccgcgagttctcagtcaacgcgggcgtcacaacacccgtcagcacctacatgctaaccaactccgaactcctcagcctcattaacgacatgcccatcaccaacgaccaaaagaaacttatgtccaacaacgttcaaatcgtccgccaacaatcctactccatcatgtgcatcatcaaagaagaagtactcgcctacgtagtccaactgcccctctacggcgtcatcgataccccatgctggaaactacacaccagccccctctgcaccaccaacaccaaagaaggctccaatatctgcttaacccgcacagaccgtggctggtactgcgataacgccggctccgtctccttcttcccccaagcagaaacctgcaaagtacaatccaaccgagtcttctgtgacaccatgaactccctaacccttccatcagaagtcaacctctgcaacatcgacatcttcaaccccaagtacgactgcaaaatcatgacatccaaaaccgatgtctcaagcagcgtcataacctcactcggcgctatcgtaagctgctacggcaaaaccaaatgcaccgcatcaaacaaaaaccgcggaatcatcaaaaccttcagcaacggatgcgactacgtttccaacaaaggcgtagacaccgtctccgtcggaaacaccctctactgcgtaaacaaacaggaaggccaatccctctacgtcaaaggcgaacccatcataaacttctacgatccccttgtcttcccgtccgatgagttcgacgcctccatctcgcaagtcaacgaaaagataaaccaatcactagcattcatccgtaaatccgacgaactcctccacaacgtcaacgtcggaaaatccaccaccaacataatgatcaccaccataatcatcgtcatcatcgtaatactattactcctcatagccgtcggcctcttcctatattgcaaagcccgatcaacccccgtaaccctttctaaagaccaactgtccggaatcaacaacatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14887 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut2 (opt1)
  source 1..1977: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14888 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut2 (opt1)
  source 1..1977: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14889 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut2 (opt2)
  source 1..1977: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14890 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut2 (opt3)
  source 1..1977: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagatcaactcagtggcattaataacatcgcattctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14891 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut2 (opt4)
  source 1..1977: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14892 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut2 (opt5)
  source 1..1977: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagatcaactctctgggatcaataacattgctttctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14893 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut2 (opt6)
  source 1..1977: mol_type = other RNA
gggagagcggctcggccattttgtcccagtcagtccggaggctgcggctgcagaagtaccgcctgcggagtaactgcaaagaagcttaccatggagcttccaatattaaaaacaaacgctataacaactatactcgcagcagttacactctgcttcgcatcctcacaaaacataactgaagaattttaccaatccacttgctcagccgtatcaaaaggatatctaggagcacttagaaccggatggtatacatcagtgataacaatagaactaagcaacataaaagaaaacaagtgcaacggaactgacgcaaaagtcaaactaatcaaacaagaactagacaaatacaaaaacgcagtaacagacctacaattactaatgcaatcaacaccagcagcaggatcaggttcagccatatgctcaggtatcgctgtatgcaaagtccttcacctagaaggtgaagtaaacaaaattaaaaacgccctactcagtacaaataaagctgtcgtaagtttatcaaacggagtatcagtccttacattcaaagtattagacctaaaaaattatatagacaaacaattactaccaatactcaacaaacaatcatgctcaataccaaatatagaaaccgtaatagaatttcagcaaaaaaataacagattactagaaataaccagagaattttcagtcaacgcaggagtcacaacacccgtctcaacctacatgctaaccaactcagaacttctatctcttatcaacgacatgcccataaccaatgatcaaaaaaaattaatgtctaataacgttcaaatagtaagacaacaatcatactcaataatgtgcataatcaaagaagaagtattagcatacgtagtacaactacccctatatggagtaatagacacaccctgctggaaactacacacatcccccctctgtacaacaaacactaaagaaggatcaaacatttgcctaacaagaacagaccgcggatggtactgcgacaacgcaggctccgtatctttctttccacaagccgaaacttgtaaagttcaatcaaacagagtattttgcgatacaatgaactccttaacattaccttcagaagtaaacctatgcaacatagacatcttcaacccaaaatacgactgcaaaataatgacctcaaaaacagacgtatcctcatcagtcataacctccttaggagcaatagtatcatgttacggaaaaacaaaatgtacagcatcaaataaaaatagaggaataataaaaaccttctccaacggatgcgactacgtatccaataaaggagtagacaccgtatcagtaggaaacacactatactgtgtaaacaaacaagaaggccaatctctatatgtaaaaggcgaaccaatcataaatttttacgacccacttgtcttcccctccgacgaatttgacgcaagcatatcacaagtaaacgaaaaaatcaaccaaagcctagccttcataaggaaatctgacgaattacttcataacgtaaatgttggaaaatcaaccacaaacataatgataaccaccatcataattgtaataatagtaatactactactactaattgcagtaggactcttcctatattgcaaagctcgctcaacaccagttaccttatcaaaagaccaactatctggaataaacaacatagccttttccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14894 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut2 (opt11)
  source 1..1977: mol_type = other RNA
gggagagcggctcggccattttgtcccagtcagtccggaggctgcggctgcagaagtaccgcctgcggagtaactgcaaagaagcttaccatggaactcccaatcctaaaaaccaacgccatcaccaccatcctcgccgctgtcaccttatgctttgccagcagccaaaacatcaccgaagaattttaccaatcaacatgctccgccgtctcaaaaggatacctcggcgccctacgcaccggctggtacacaagcgtcataaccatcgagctctccaacatcaaggaaaacaaatgcaatggaaccgacgccaaagtcaaactaatcaaacaagaactagacaagtacaagaacgcagtcaccgacctccaactcctcatgcagtccacccccgcagcaggctctggctcagcaatatgctccggcatcgctgtctgcaaagtcctacacctcgaaggcgaagtcaacaaaatcaaaaacgccctactgtccacaaacaaagccgtcgtctccctatccaacggcgtctcggtcctaacctttaaggttctcgatctcaaaaattacatagacaaacaactactccccatcctcaacaaacaatcttgctcaatccccaacatcgaaaccgtcatcgagttccaacagaaaaacaacagactactcgaaatcacccgcgagttctcagtcaacgcgggcgtcacaacacccgtcagcacctacatgctaaccaactccgaactcctcagcctcattaacgacatgcccatcaccaacgaccaaaagaaacttatgtccaacaacgttcaaatcgtccgccaacaatcctactccatcatgtgcatcatcaaagaagaagtactcgcctacgtagtccaactgcccctctacggcgtcatcgataccccatgctggaaactacacaccagccccctctgcaccaccaacaccaaagaaggctccaatatctgcttaacccgcacagaccgtggctggtactgcgataacgccggctccgtctccttcttcccccaagcagaaacctgcaaagtacaatccaaccgagtcttctgtgacaccatgaactccctaacccttccatcagaagtcaacctctgcaacatcgacatcttcaaccccaagtacgactgcaaaatcatgacatccaaaaccgatgtctcaagcagcgtcataacctcactcggcgctatcgtaagctgctacggcaaaaccaaatgcaccgcatcaaacaaaaaccgcggaatcatcaaaaccttcagcaacggatgcgactacgtttccaacaaaggcgtagacaccgtctccgtcggaaacaccctctactgcgtaaacaaacaggaaggccaatccctctacgtcaaaggcgaacccatcataaacttctacgatccccttgtcttcccgtccgatgagttcgacgcctccatctcgcaagtcaacgaaaagataaaccaatcactagcattcatccgtaaatccgacgaactcctccacaacgtcaacgtcggaaaatccaccaccaacataatgatcaccaccataatcatcgtcatcatcgtaatactattactcctcatagccgtcggcctcttcctatattgcaaagcccgatcaacccccgtaaccctttctaaagaccaactgtccggaatcaacaacatcgctttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14895 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut2 (opt1)
  source 1..2193: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14896 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut2 (opt1)
  source 1..2193: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14897 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut2 (opt2)
  source 1..2193: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14898 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut2 (opt3)
  source 1..2193: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagatcaactcagtggcattaataacatcgcattctctaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14899 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut2 (opt4)
  source 1..2193: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14900 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut2 (opt5)
  source 1..2193: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagatcaactctctgggatcaataacattgctttctccaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14901 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut2 (opt6)
  source 1..2193: mol_type = other RNA
gggagagcggctcggccattttgtcccagtcagtccggaggctgcggctgcagaagtaccgcctgcggagtaactgcaaagaagcttaccatggagcttccaatattaaaaacaaacgctataacaactatactcgcagcagttacactctgcttcgcatcctcacaaaacataactgaagaattttaccaatccacttgctcagccgtatcaaaaggatatctaggagcacttagaaccggatggtatacatcagtgataacaatagaactaagcaacataaaagaaaacaagtgcaacggaactgacgcaaaagtcaaactaatcaaacaagaactagacaaatacaaaaacgcagtaacagacctacaattactaatgcaatcaacaccagcagcaggatcaggttcagccatatgctcaggtatcgctgtatgcaaagtccttcacctagaaggtgaagtaaacaaaattaaaaacgccctactcagtacaaataaagctgtcgtaagtttatcaaacggagtatcagtccttacattcaaagtattagacctaaaaaattatatagacaaacaattactaccaatactcaacaaacaatcatgctcaataccaaatatagaaaccgtaatagaatttcagcaaaaaaataacagattactagaaataaccagagaattttcagtcaacgcaggagtcacaacacccgtctcaacctacatgctaaccaactcagaacttctatctcttatcaacgacatgcccataaccaatgatcaaaaaaaattaatgtctaataacgttcaaatagtaagacaacaatcatactcaataatgtgcataatcaaagaagaagtattagcatacgtagtacaactacccctatatggagtaatagacacaccctgctggaaactacacacatcccccctctgtacaacaaacactaaagaaggatcaaacatttgcctaacaagaacagaccgcggatggtactgcgacaacgcaggctccgtatctttctttccacaagccgaaacttgtaaagttcaatcaaacagagtattttgcgatacaatgaactccttaacattaccttcagaagtaaacctatgcaacatagacatcttcaacccaaaatacgactgcaaaataatgacctcaaaaacagacgtatcctcatcagtcataacctccttaggagcaatagtatcatgttacggaaaaacaaaatgtacagcatcaaataaaaatagaggaataataaaaaccttctccaacggatgcgactacgtatccaataaaggagtagacaccgtatcagtaggaaacacactatactgtgtaaacaaacaagaaggccaatctctatatgtaaaaggcgaaccaatcataaatttttacgacccacttgtcttcccctccgacgaatttgacgcaagcatatcacaagtaaacgaaaaaatcaaccaaagcctagccttcataaggaaatctgacgaattacttcataacgtaaatgttggaaaatcaaccacaaacataatgataaccaccatcataattgtaataatagtaatactactactactaattgcagtaggactcttcctatattgcaaagctcgctcaacaccagttaccttatcaaaagaccaactatctggaataaacaacatagccttttccaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14902 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut2 (opt11)
  source 1..2193: mol_type = other RNA
gggagagcggctcggccattttgtcccagtcagtccggaggctgcggctgcagaagtaccgcctgcggagtaactgcaaagaagcttaccatggaactcccaatcctaaaaaccaacgccatcaccaccatcctcgccgctgtcaccttatgctttgccagcagccaaaacatcaccgaagaattttaccaatcaacatgctccgccgtctcaaaaggatacctcggcgccctacgcaccggctggtacacaagcgtcataaccatcgagctctccaacatcaaggaaaacaaatgcaatggaaccgacgccaaagtcaaactaatcaaacaagaactagacaagtacaagaacgcagtcaccgacctccaactcctcatgcagtccacccccgcagcaggctctggctcagcaatatgctccggcatcgctgtctgcaaagtcctacacctcgaaggcgaagtcaacaaaatcaaaaacgccctactgtccacaaacaaagccgtcgtctccctatccaacggcgtctcggtcctaacctttaaggttctcgatctcaaaaattacatagacaaacaactactccccatcctcaacaaacaatcttgctcaatccccaacatcgaaaccgtcatcgagttccaacagaaaaacaacagactactcgaaatcacccgcgagttctcagtcaacgcgggcgtcacaacacccgtcagcacctacatgctaaccaactccgaactcctcagcctcattaacgacatgcccatcaccaacgaccaaaagaaacttatgtccaacaacgttcaaatcgtccgccaacaatcctactccatcatgtgcatcatcaaagaagaagtactcgcctacgtagtccaactgcccctctacggcgtcatcgataccccatgctggaaactacacaccagccccctctgcaccaccaacaccaaagaaggctccaatatctgcttaacccgcacagaccgtggctggtactgcgataacgccggctccgtctccttcttcccccaagcagaaacctgcaaagtacaatccaaccgagtcttctgtgacaccatgaactccctaacccttccatcagaagtcaacctctgcaacatcgacatcttcaaccccaagtacgactgcaaaatcatgacatccaaaaccgatgtctcaagcagcgtcataacctcactcggcgctatcgtaagctgctacggcaaaaccaaatgcaccgcatcaaacaaaaaccgcggaatcatcaaaaccttcagcaacggatgcgactacgtttccaacaaaggcgtagacaccgtctccgtcggaaacaccctctactgcgtaaacaaacaggaaggccaatccctctacgtcaaaggcgaacccatcataaacttctacgatccccttgtcttcccgtccgatgagttcgacgcctccatctcgcaagtcaacgaaaagataaaccaatcactagcattcatccgtaaatccgacgaactcctccacaacgtcaacgtcggaaaatccaccaccaacataatgatcaccaccataatcatcgtcatcatcgtaatactattactcctcatagccgtcggcctcttcctatattgcaaagcccgatcaacccccgtaaccctttctaaagaccaactgtccggaatcaacaacatcgctttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14903 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut2 (opt1)
  source 1..1973: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14904 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut2 (opt1)
  source 1..1973: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14905 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut2 (opt2)
  source 1..1973: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14906 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut2 (opt3)
  source 1..1973: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagatcaactcagtggcattaataacatcgcattctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14907 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut2 (opt4)
  source 1..1973: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14908 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut2 (opt5)
  source 1..1973: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagatcaactctctgggatcaataacattgctttctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14909 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut2 (opt6)
  source 1..1973: mol_type = other RNA
gggagagcggctcggccattttgtcccagtcagtccggaggctgcggctgcagaagtaccgcctgcggagtaactgcaaagaagcttaccatggagcttccaatattaaaaacaaacgctataacaactatactcgcagcagttacactctgcttcgcatcctcacaaaacataactgaagaattttaccaatccacttgctcagccgtatcaaaaggatatctaggagcacttagaaccggatggtatacatcagtgataacaatagaactaagcaacataaaagaaaacaagtgcaacggaactgacgcaaaagtcaaactaatcaaacaagaactagacaaatacaaaaacgcagtaacagacctacaattactaatgcaatcaacaccagcagcaggatcaggttcagccatatgctcaggtatcgctgtatgcaaagtccttcacctagaaggtgaagtaaacaaaattaaaaacgccctactcagtacaaataaagctgtcgtaagtttatcaaacggagtatcagtccttacattcaaagtattagacctaaaaaattatatagacaaacaattactaccaatactcaacaaacaatcatgctcaataccaaatatagaaaccgtaatagaatttcagcaaaaaaataacagattactagaaataaccagagaattttcagtcaacgcaggagtcacaacacccgtctcaacctacatgctaaccaactcagaacttctatctcttatcaacgacatgcccataaccaatgatcaaaaaaaattaatgtctaataacgttcaaatagtaagacaacaatcatactcaataatgtgcataatcaaagaagaagtattagcatacgtagtacaactacccctatatggagtaatagacacaccctgctggaaactacacacatcccccctctgtacaacaaacactaaagaaggatcaaacatttgcctaacaagaacagaccgcggatggtactgcgacaacgcaggctccgtatctttctttccacaagccgaaacttgtaaagttcaatcaaacagagtattttgcgatacaatgaactccttaacattaccttcagaagtaaacctatgcaacatagacatcttcaacccaaaatacgactgcaaaataatgacctcaaaaacagacgtatcctcatcagtcataacctccttaggagcaatagtatcatgttacggaaaaacaaaatgtacagcatcaaataaaaatagaggaataataaaaaccttctccaacggatgcgactacgtatccaataaaggagtagacaccgtatcagtaggaaacacactatactgtgtaaacaaacaagaaggccaatctctatatgtaaaaggcgaaccaatcataaatttttacgacccacttgtcttcccctccgacgaatttgacgcaagcatatcacaagtaaacgaaaaaatcaaccaaagcctagccttcataaggaaatctgacgaattacttcataacgtaaatgttggaaaatcaaccacaaacataatgataaccaccatcataattgtaataatagtaatactactactactaattgcagtaggactcttcctatattgcaaagctcgctcaacaccagttaccttatcaaaagaccaactatctggaataaacaacatagccttttccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14910 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut2 (opt11)
  source 1..1973: mol_type = other RNA
gggagagcggctcggccattttgtcccagtcagtccggaggctgcggctgcagaagtaccgcctgcggagtaactgcaaagaagcttaccatggaactcccaatcctaaaaaccaacgccatcaccaccatcctcgccgctgtcaccttatgctttgccagcagccaaaacatcaccgaagaattttaccaatcaacatgctccgccgtctcaaaaggatacctcggcgccctacgcaccggctggtacacaagcgtcataaccatcgagctctccaacatcaaggaaaacaaatgcaatggaaccgacgccaaagtcaaactaatcaaacaagaactagacaagtacaagaacgcagtcaccgacctccaactcctcatgcagtccacccccgcagcaggctctggctcagcaatatgctccggcatcgctgtctgcaaagtcctacacctcgaaggcgaagtcaacaaaatcaaaaacgccctactgtccacaaacaaagccgtcgtctccctatccaacggcgtctcggtcctaacctttaaggttctcgatctcaaaaattacatagacaaacaactactccccatcctcaacaaacaatcttgctcaatccccaacatcgaaaccgtcatcgagttccaacagaaaaacaacagactactcgaaatcacccgcgagttctcagtcaacgcgggcgtcacaacacccgtcagcacctacatgctaaccaactccgaactcctcagcctcattaacgacatgcccatcaccaacgaccaaaagaaacttatgtccaacaacgttcaaatcgtccgccaacaatcctactccatcatgtgcatcatcaaagaagaagtactcgcctacgtagtccaactgcccctctacggcgtcatcgataccccatgctggaaactacacaccagccccctctgcaccaccaacaccaaagaaggctccaatatctgcttaacccgcacagaccgtggctggtactgcgataacgccggctccgtctccttcttcccccaagcagaaacctgcaaagtacaatccaaccgagtcttctgtgacaccatgaactccctaacccttccatcagaagtcaacctctgcaacatcgacatcttcaaccccaagtacgactgcaaaatcatgacatccaaaaccgatgtctcaagcagcgtcataacctcactcggcgctatcgtaagctgctacggcaaaaccaaatgcaccgcatcaaacaaaaaccgcggaatcatcaaaaccttcagcaacggatgcgactacgtttccaacaaaggcgtagacaccgtctccgtcggaaacaccctctactgcgtaaacaaacaggaaggccaatccctctacgtcaaaggcgaacccatcataaacttctacgatccccttgtcttcccgtccgatgagttcgacgcctccatctcgcaagtcaacgaaaagataaaccaatcactagcattcatccgtaaatccgacgaactcctccacaacgtcaacgtcggaaaatccaccaccaacataatgatcaccaccataatcatcgtcatcatcgtaatactattactcctcatagccgtcggcctcttcctatattgcaaagcccgatcaacccccgtaaccctttctaaagaccaactgtccggaatcaacaacatcgctttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14911 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut2 (opt1)
  source 1..1964: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14912 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut2 (opt1)
  source 1..1964: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14913 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut2 (opt2)
  source 1..1964: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14914 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut2 (opt3)
  source 1..1964: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagatcaactcagtggcattaataacatcgcattctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14915 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut2 (opt4)
  source 1..1964: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14916 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut2 (opt5)
  source 1..1964: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagatcaactctctgggatcaataacattgctttctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14917 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut2 (opt6)
  source 1..1964: mol_type = other RNA
gggagagtcccgcagtcggcgtccagcggctctgcttgttcgtgtgtgtgtcgttgcaggccttattcaagcttaccatggagcttccaatattaaaaacaaacgctataacaactatactcgcagcagttacactctgcttcgcatcctcacaaaacataactgaagaattttaccaatccacttgctcagccgtatcaaaaggatatctaggagcacttagaaccggatggtatacatcagtgataacaatagaactaagcaacataaaagaaaacaagtgcaacggaactgacgcaaaagtcaaactaatcaaacaagaactagacaaatacaaaaacgcagtaacagacctacaattactaatgcaatcaacaccagcagcaggatcaggttcagccatatgctcaggtatcgctgtatgcaaagtccttcacctagaaggtgaagtaaacaaaattaaaaacgccctactcagtacaaataaagctgtcgtaagtttatcaaacggagtatcagtccttacattcaaagtattagacctaaaaaattatatagacaaacaattactaccaatactcaacaaacaatcatgctcaataccaaatatagaaaccgtaatagaatttcagcaaaaaaataacagattactagaaataaccagagaattttcagtcaacgcaggagtcacaacacccgtctcaacctacatgctaaccaactcagaacttctatctcttatcaacgacatgcccataaccaatgatcaaaaaaaattaatgtctaataacgttcaaatagtaagacaacaatcatactcaataatgtgcataatcaaagaagaagtattagcatacgtagtacaactacccctatatggagtaatagacacaccctgctggaaactacacacatcccccctctgtacaacaaacactaaagaaggatcaaacatttgcctaacaagaacagaccgcggatggtactgcgacaacgcaggctccgtatctttctttccacaagccgaaacttgtaaagttcaatcaaacagagtattttgcgatacaatgaactccttaacattaccttcagaagtaaacctatgcaacatagacatcttcaacccaaaatacgactgcaaaataatgacctcaaaaacagacgtatcctcatcagtcataacctccttaggagcaatagtatcatgttacggaaaaacaaaatgtacagcatcaaataaaaatagaggaataataaaaaccttctccaacggatgcgactacgtatccaataaaggagtagacaccgtatcagtaggaaacacactatactgtgtaaacaaacaagaaggccaatctctatatgtaaaaggcgaaccaatcataaatttttacgacccacttgtcttcccctccgacgaatttgacgcaagcatatcacaagtaaacgaaaaaatcaaccaaagcctagccttcataaggaaatctgacgaattacttcataacgtaaatgttggaaaatcaaccacaaacataatgataaccaccatcataattgtaataatagtaatactactactactaattgcagtaggactcttcctatattgcaaagctcgctcaacaccagttaccttatcaaaagaccaactatctggaataaacaacatagccttttccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14918 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut2 (opt11)
  source 1..1964: mol_type = other RNA
gggagagtcccgcagtcggcgtccagcggctctgcttgttcgtgtgtgtgtcgttgcaggccttattcaagcttaccatggaactcccaatcctaaaaaccaacgccatcaccaccatcctcgccgctgtcaccttatgctttgccagcagccaaaacatcaccgaagaattttaccaatcaacatgctccgccgtctcaaaaggatacctcggcgccctacgcaccggctggtacacaagcgtcataaccatcgagctctccaacatcaaggaaaacaaatgcaatggaaccgacgccaaagtcaaactaatcaaacaagaactagacaagtacaagaacgcagtcaccgacctccaactcctcatgcagtccacccccgcagcaggctctggctcagcaatatgctccggcatcgctgtctgcaaagtcctacacctcgaaggcgaagtcaacaaaatcaaaaacgccctactgtccacaaacaaagccgtcgtctccctatccaacggcgtctcggtcctaacctttaaggttctcgatctcaaaaattacatagacaaacaactactccccatcctcaacaaacaatcttgctcaatccccaacatcgaaaccgtcatcgagttccaacagaaaaacaacagactactcgaaatcacccgcgagttctcagtcaacgcgggcgtcacaacacccgtcagcacctacatgctaaccaactccgaactcctcagcctcattaacgacatgcccatcaccaacgaccaaaagaaacttatgtccaacaacgttcaaatcgtccgccaacaatcctactccatcatgtgcatcatcaaagaagaagtactcgcctacgtagtccaactgcccctctacggcgtcatcgataccccatgctggaaactacacaccagccccctctgcaccaccaacaccaaagaaggctccaatatctgcttaacccgcacagaccgtggctggtactgcgataacgccggctccgtctccttcttcccccaagcagaaacctgcaaagtacaatccaaccgagtcttctgtgacaccatgaactccctaacccttccatcagaagtcaacctctgcaacatcgacatcttcaaccccaagtacgactgcaaaatcatgacatccaaaaccgatgtctcaagcagcgtcataacctcactcggcgctatcgtaagctgctacggcaaaaccaaatgcaccgcatcaaacaaaaaccgcggaatcatcaaaaccttcagcaacggatgcgactacgtttccaacaaaggcgtagacaccgtctccgtcggaaacaccctctactgcgtaaacaaacaggaaggccaatccctctacgtcaaaggcgaacccatcataaacttctacgatccccttgtcttcccgtccgatgagttcgacgcctccatctcgcaagtcaacgaaaagataaaccaatcactagcattcatccgtaaatccgacgaactcctccacaacgtcaacgtcggaaaatccaccaccaacataatgatcaccaccataatcatcgtcatcatcgtaatactattactcctcatagccgtcggcctcttcctatattgcaaagcccgatcaacccccgtaaccctttctaaagaccaactgtccggaatcaacaacatcgctttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14919 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut2 (opt1)
  source 1..2180: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14920 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut2 (opt1)
  source 1..2180: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14921 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut2 (opt2)
  source 1..2180: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14922 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut2 (opt3)
  source 1..2180: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagatcaactcagtggcattaataacatcgcattctctaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14923 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut2 (opt4)
  source 1..2180: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14924 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut2 (opt5)
  source 1..2180: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagatcaactctctgggatcaataacattgctttctccaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14925 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut2 (opt6)
  source 1..2180: mol_type = other RNA
gggagagtcccgcagtcggcgtccagcggctctgcttgttcgtgtgtgtgtcgttgcaggccttattcaagcttaccatggagcttccaatattaaaaacaaacgctataacaactatactcgcagcagttacactctgcttcgcatcctcacaaaacataactgaagaattttaccaatccacttgctcagccgtatcaaaaggatatctaggagcacttagaaccggatggtatacatcagtgataacaatagaactaagcaacataaaagaaaacaagtgcaacggaactgacgcaaaagtcaaactaatcaaacaagaactagacaaatacaaaaacgcagtaacagacctacaattactaatgcaatcaacaccagcagcaggatcaggttcagccatatgctcaggtatcgctgtatgcaaagtccttcacctagaaggtgaagtaaacaaaattaaaaacgccctactcagtacaaataaagctgtcgtaagtttatcaaacggagtatcagtccttacattcaaagtattagacctaaaaaattatatagacaaacaattactaccaatactcaacaaacaatcatgctcaataccaaatatagaaaccgtaatagaatttcagcaaaaaaataacagattactagaaataaccagagaattttcagtcaacgcaggagtcacaacacccgtctcaacctacatgctaaccaactcagaacttctatctcttatcaacgacatgcccataaccaatgatcaaaaaaaattaatgtctaataacgttcaaatagtaagacaacaatcatactcaataatgtgcataatcaaagaagaagtattagcatacgtagtacaactacccctatatggagtaatagacacaccctgctggaaactacacacatcccccctctgtacaacaaacactaaagaaggatcaaacatttgcctaacaagaacagaccgcggatggtactgcgacaacgcaggctccgtatctttctttccacaagccgaaacttgtaaagttcaatcaaacagagtattttgcgatacaatgaactccttaacattaccttcagaagtaaacctatgcaacatagacatcttcaacccaaaatacgactgcaaaataatgacctcaaaaacagacgtatcctcatcagtcataacctccttaggagcaatagtatcatgttacggaaaaacaaaatgtacagcatcaaataaaaatagaggaataataaaaaccttctccaacggatgcgactacgtatccaataaaggagtagacaccgtatcagtaggaaacacactatactgtgtaaacaaacaagaaggccaatctctatatgtaaaaggcgaaccaatcataaatttttacgacccacttgtcttcccctccgacgaatttgacgcaagcatatcacaagtaaacgaaaaaatcaaccaaagcctagccttcataaggaaatctgacgaattacttcataacgtaaatgttggaaaatcaaccacaaacataatgataaccaccatcataattgtaataatagtaatactactactactaattgcagtaggactcttcctatattgcaaagctcgctcaacaccagttaccttatcaaaagaccaactatctggaataaacaacatagccttttccaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14926 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut2 (opt11)
  source 1..2180: mol_type = other RNA
gggagagtcccgcagtcggcgtccagcggctctgcttgttcgtgtgtgtgtcgttgcaggccttattcaagcttaccatggaactcccaatcctaaaaaccaacgccatcaccaccatcctcgccgctgtcaccttatgctttgccagcagccaaaacatcaccgaagaattttaccaatcaacatgctccgccgtctcaaaaggatacctcggcgccctacgcaccggctggtacacaagcgtcataaccatcgagctctccaacatcaaggaaaacaaatgcaatggaaccgacgccaaagtcaaactaatcaaacaagaactagacaagtacaagaacgcagtcaccgacctccaactcctcatgcagtccacccccgcagcaggctctggctcagcaatatgctccggcatcgctgtctgcaaagtcctacacctcgaaggcgaagtcaacaaaatcaaaaacgccctactgtccacaaacaaagccgtcgtctccctatccaacggcgtctcggtcctaacctttaaggttctcgatctcaaaaattacatagacaaacaactactccccatcctcaacaaacaatcttgctcaatccccaacatcgaaaccgtcatcgagttccaacagaaaaacaacagactactcgaaatcacccgcgagttctcagtcaacgcgggcgtcacaacacccgtcagcacctacatgctaaccaactccgaactcctcagcctcattaacgacatgcccatcaccaacgaccaaaagaaacttatgtccaacaacgttcaaatcgtccgccaacaatcctactccatcatgtgcatcatcaaagaagaagtactcgcctacgtagtccaactgcccctctacggcgtcatcgataccccatgctggaaactacacaccagccccctctgcaccaccaacaccaaagaaggctccaatatctgcttaacccgcacagaccgtggctggtactgcgataacgccggctccgtctccttcttcccccaagcagaaacctgcaaagtacaatccaaccgagtcttctgtgacaccatgaactccctaacccttccatcagaagtcaacctctgcaacatcgacatcttcaaccccaagtacgactgcaaaatcatgacatccaaaaccgatgtctcaagcagcgtcataacctcactcggcgctatcgtaagctgctacggcaaaaccaaatgcaccgcatcaaacaaaaaccgcggaatcatcaaaaccttcagcaacggatgcgactacgtttccaacaaaggcgtagacaccgtctccgtcggaaacaccctctactgcgtaaacaaacaggaaggccaatccctctacgtcaaaggcgaacccatcataaacttctacgatccccttgtcttcccgtccgatgagttcgacgcctccatctcgcaagtcaacgaaaagataaaccaatcactagcattcatccgtaaatccgacgaactcctccacaacgtcaacgtcggaaaatccaccaccaacataatgatcaccaccataatcatcgtcatcatcgtaatactattactcctcatagccgtcggcctcttcctatattgcaaagcccgatcaacccccgtaaccctttctaaagaccaactgtccggaatcaacaacatcgctttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14927 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut2 (opt1)
  source 1..1956: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14928 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut2 (opt1)
  source 1..1956: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14929 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut2 (opt2)
  source 1..1956: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14930 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut2 (opt3)
  source 1..1956: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagatcaactcagtggcattaataacatcgcattctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14931 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut2 (opt4)
  source 1..1956: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14932 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut2 (opt5)
  source 1..1956: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagatcaactctctgggatcaataacattgctttctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14933 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut2 (opt6)
  source 1..1956: mol_type = other RNA
gggagactttcccattctgtagcagaatttggtgttgcctgtggtcttggtcccgcggagaagcttaccatggagcttccaatattaaaaacaaacgctataacaactatactcgcagcagttacactctgcttcgcatcctcacaaaacataactgaagaattttaccaatccacttgctcagccgtatcaaaaggatatctaggagcacttagaaccggatggtatacatcagtgataacaatagaactaagcaacataaaagaaaacaagtgcaacggaactgacgcaaaagtcaaactaatcaaacaagaactagacaaatacaaaaacgcagtaacagacctacaattactaatgcaatcaacaccagcagcaggatcaggttcagccatatgctcaggtatcgctgtatgcaaagtccttcacctagaaggtgaagtaaacaaaattaaaaacgccctactcagtacaaataaagctgtcgtaagtttatcaaacggagtatcagtccttacattcaaagtattagacctaaaaaattatatagacaaacaattactaccaatactcaacaaacaatcatgctcaataccaaatatagaaaccgtaatagaatttcagcaaaaaaataacagattactagaaataaccagagaattttcagtcaacgcaggagtcacaacacccgtctcaacctacatgctaaccaactcagaacttctatctcttatcaacgacatgcccataaccaatgatcaaaaaaaattaatgtctaataacgttcaaatagtaagacaacaatcatactcaataatgtgcataatcaaagaagaagtattagcatacgtagtacaactacccctatatggagtaatagacacaccctgctggaaactacacacatcccccctctgtacaacaaacactaaagaaggatcaaacatttgcctaacaagaacagaccgcggatggtactgcgacaacgcaggctccgtatctttctttccacaagccgaaacttgtaaagttcaatcaaacagagtattttgcgatacaatgaactccttaacattaccttcagaagtaaacctatgcaacatagacatcttcaacccaaaatacgactgcaaaataatgacctcaaaaacagacgtatcctcatcagtcataacctccttaggagcaatagtatcatgttacggaaaaacaaaatgtacagcatcaaataaaaatagaggaataataaaaaccttctccaacggatgcgactacgtatccaataaaggagtagacaccgtatcagtaggaaacacactatactgtgtaaacaaacaagaaggccaatctctatatgtaaaaggcgaaccaatcataaatttttacgacccacttgtcttcccctccgacgaatttgacgcaagcatatcacaagtaaacgaaaaaatcaaccaaagcctagccttcataaggaaatctgacgaattacttcataacgtaaatgttggaaaatcaaccacaaacataatgataaccaccatcataattgtaataatagtaatactactactactaattgcagtaggactcttcctatattgcaaagctcgctcaacaccagttaccttatcaaaagaccaactatctggaataaacaacatagccttttccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14934 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut2 (opt11)
  source 1..1956: mol_type = other RNA
gggagactttcccattctgtagcagaatttggtgttgcctgtggtcttggtcccgcggagaagcttaccatggaactcccaatcctaaaaaccaacgccatcaccaccatcctcgccgctgtcaccttatgctttgccagcagccaaaacatcaccgaagaattttaccaatcaacatgctccgccgtctcaaaaggatacctcggcgccctacgcaccggctggtacacaagcgtcataaccatcgagctctccaacatcaaggaaaacaaatgcaatggaaccgacgccaaagtcaaactaatcaaacaagaactagacaagtacaagaacgcagtcaccgacctccaactcctcatgcagtccacccccgcagcaggctctggctcagcaatatgctccggcatcgctgtctgcaaagtcctacacctcgaaggcgaagtcaacaaaatcaaaaacgccctactgtccacaaacaaagccgtcgtctccctatccaacggcgtctcggtcctaacctttaaggttctcgatctcaaaaattacatagacaaacaactactccccatcctcaacaaacaatcttgctcaatccccaacatcgaaaccgtcatcgagttccaacagaaaaacaacagactactcgaaatcacccgcgagttctcagtcaacgcgggcgtcacaacacccgtcagcacctacatgctaaccaactccgaactcctcagcctcattaacgacatgcccatcaccaacgaccaaaagaaacttatgtccaacaacgttcaaatcgtccgccaacaatcctactccatcatgtgcatcatcaaagaagaagtactcgcctacgtagtccaactgcccctctacggcgtcatcgataccccatgctggaaactacacaccagccccctctgcaccaccaacaccaaagaaggctccaatatctgcttaacccgcacagaccgtggctggtactgcgataacgccggctccgtctccttcttcccccaagcagaaacctgcaaagtacaatccaaccgagtcttctgtgacaccatgaactccctaacccttccatcagaagtcaacctctgcaacatcgacatcttcaaccccaagtacgactgcaaaatcatgacatccaaaaccgatgtctcaagcagcgtcataacctcactcggcgctatcgtaagctgctacggcaaaaccaaatgcaccgcatcaaacaaaaaccgcggaatcatcaaaaccttcagcaacggatgcgactacgtttccaacaaaggcgtagacaccgtctccgtcggaaacaccctctactgcgtaaacaaacaggaaggccaatccctctacgtcaaaggcgaacccatcataaacttctacgatccccttgtcttcccgtccgatgagttcgacgcctccatctcgcaagtcaacgaaaagataaaccaatcactagcattcatccgtaaatccgacgaactcctccacaacgtcaacgtcggaaaatccaccaccaacataatgatcaccaccataatcatcgtcatcatcgtaatactattactcctcatagccgtcggcctcttcctatattgcaaagcccgatcaacccccgtaaccctttctaaagaccaactgtccggaatcaacaacatcgctttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14935 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut2 (opt1)
  source 1..1952: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14936 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut2 (opt1)
  source 1..1952: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14937 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut2 (opt2)
  source 1..1952: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14938 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut2 (opt3)
  source 1..1952: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagatcaactcagtggcattaataacatcgcattctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14939 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut2 (opt4)
  source 1..1952: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14940 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut2 (opt5)
  source 1..1952: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagatcaactctctgggatcaataacattgctttctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14941 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut2 (opt6)
  source 1..1952: mol_type = other RNA
gggagactttcccattctgtagcagaatttggtgttgcctgtggtcttggtcccgcggagaagcttaccatggagcttccaatattaaaaacaaacgctataacaactatactcgcagcagttacactctgcttcgcatcctcacaaaacataactgaagaattttaccaatccacttgctcagccgtatcaaaaggatatctaggagcacttagaaccggatggtatacatcagtgataacaatagaactaagcaacataaaagaaaacaagtgcaacggaactgacgcaaaagtcaaactaatcaaacaagaactagacaaatacaaaaacgcagtaacagacctacaattactaatgcaatcaacaccagcagcaggatcaggttcagccatatgctcaggtatcgctgtatgcaaagtccttcacctagaaggtgaagtaaacaaaattaaaaacgccctactcagtacaaataaagctgtcgtaagtttatcaaacggagtatcagtccttacattcaaagtattagacctaaaaaattatatagacaaacaattactaccaatactcaacaaacaatcatgctcaataccaaatatagaaaccgtaatagaatttcagcaaaaaaataacagattactagaaataaccagagaattttcagtcaacgcaggagtcacaacacccgtctcaacctacatgctaaccaactcagaacttctatctcttatcaacgacatgcccataaccaatgatcaaaaaaaattaatgtctaataacgttcaaatagtaagacaacaatcatactcaataatgtgcataatcaaagaagaagtattagcatacgtagtacaactacccctatatggagtaatagacacaccctgctggaaactacacacatcccccctctgtacaacaaacactaaagaaggatcaaacatttgcctaacaagaacagaccgcggatggtactgcgacaacgcaggctccgtatctttctttccacaagccgaaacttgtaaagttcaatcaaacagagtattttgcgatacaatgaactccttaacattaccttcagaagtaaacctatgcaacatagacatcttcaacccaaaatacgactgcaaaataatgacctcaaaaacagacgtatcctcatcagtcataacctccttaggagcaatagtatcatgttacggaaaaacaaaatgtacagcatcaaataaaaatagaggaataataaaaaccttctccaacggatgcgactacgtatccaataaaggagtagacaccgtatcagtaggaaacacactatactgtgtaaacaaacaagaaggccaatctctatatgtaaaaggcgaaccaatcataaatttttacgacccacttgtcttcccctccgacgaatttgacgcaagcatatcacaagtaaacgaaaaaatcaaccaaagcctagccttcataaggaaatctgacgaattacttcataacgtaaatgttggaaaatcaaccacaaacataatgataaccaccatcataattgtaataatagtaatactactactactaattgcagtaggactcttcctatattgcaaagctcgctcaacaccagttaccttatcaaaagaccaactatctggaataaacaacatagccttttccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14942 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut2 (opt11)
  source 1..1952: mol_type = other RNA
gggagactttcccattctgtagcagaatttggtgttgcctgtggtcttggtcccgcggagaagcttaccatggaactcccaatcctaaaaaccaacgccatcaccaccatcctcgccgctgtcaccttatgctttgccagcagccaaaacatcaccgaagaattttaccaatcaacatgctccgccgtctcaaaaggatacctcggcgccctacgcaccggctggtacacaagcgtcataaccatcgagctctccaacatcaaggaaaacaaatgcaatggaaccgacgccaaagtcaaactaatcaaacaagaactagacaagtacaagaacgcagtcaccgacctccaactcctcatgcagtccacccccgcagcaggctctggctcagcaatatgctccggcatcgctgtctgcaaagtcctacacctcgaaggcgaagtcaacaaaatcaaaaacgccctactgtccacaaacaaagccgtcgtctccctatccaacggcgtctcggtcctaacctttaaggttctcgatctcaaaaattacatagacaaacaactactccccatcctcaacaaacaatcttgctcaatccccaacatcgaaaccgtcatcgagttccaacagaaaaacaacagactactcgaaatcacccgcgagttctcagtcaacgcgggcgtcacaacacccgtcagcacctacatgctaaccaactccgaactcctcagcctcattaacgacatgcccatcaccaacgaccaaaagaaacttatgtccaacaacgttcaaatcgtccgccaacaatcctactccatcatgtgcatcatcaaagaagaagtactcgcctacgtagtccaactgcccctctacggcgtcatcgataccccatgctggaaactacacaccagccccctctgcaccaccaacaccaaagaaggctccaatatctgcttaacccgcacagaccgtggctggtactgcgataacgccggctccgtctccttcttcccccaagcagaaacctgcaaagtacaatccaaccgagtcttctgtgacaccatgaactccctaacccttccatcagaagtcaacctctgcaacatcgacatcttcaaccccaagtacgactgcaaaatcatgacatccaaaaccgatgtctcaagcagcgtcataacctcactcggcgctatcgtaagctgctacggcaaaaccaaatgcaccgcatcaaacaaaaaccgcggaatcatcaaaaccttcagcaacggatgcgactacgtttccaacaaaggcgtagacaccgtctccgtcggaaacaccctctactgcgtaaacaaacaggaaggccaatccctctacgtcaaaggcgaacccatcataaacttctacgatccccttgtcttcccgtccgatgagttcgacgcctccatctcgcaagtcaacgaaaagataaaccaatcactagcattcatccgtaaatccgacgaactcctccacaacgtcaacgtcggaaaatccaccaccaacataatgatcaccaccataatcatcgtcatcatcgtaatactattactcctcatagccgtcggcctcttcctatattgcaaagcccgatcaacccccgtaaccctttctaaagaccaactgtccggaatcaacaacatcgctttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14943 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut2 (opt1)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14944 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut2 (opt1)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14945 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut2 (opt2)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14946 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut2 (opt3)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagatcaactcagtggcattaataacatcgcattctctaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14947 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut2 (opt4)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14948 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut2 (opt5)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagatcaactctctgggatcaataacattgctttctccaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14949 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut2 (opt6)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagcttccaatattaaaaacaaacgctataacaactatactcgcagcagttacactctgcttcgcatcctcacaaaacataactgaagaattttaccaatccacttgctcagccgtatcaaaaggatatctaggagcacttagaaccggatggtatacatcagtgataacaatagaactaagcaacataaaagaaaacaagtgcaacggaactgacgcaaaagtcaaactaatcaaacaagaactagacaaatacaaaaacgcagtaacagacctacaattactaatgcaatcaacaccagcagcaggatcaggttcagccatatgctcaggtatcgctgtatgcaaagtccttcacctagaaggtgaagtaaacaaaattaaaaacgccctactcagtacaaataaagctgtcgtaagtttatcaaacggagtatcagtccttacattcaaagtattagacctaaaaaattatatagacaaacaattactaccaatactcaacaaacaatcatgctcaataccaaatatagaaaccgtaatagaatttcagcaaaaaaataacagattactagaaataaccagagaattttcagtcaacgcaggagtcacaacacccgtctcaacctacatgctaaccaactcagaacttctatctcttatcaacgacatgcccataaccaatgatcaaaaaaaattaatgtctaataacgttcaaatagtaagacaacaatcatactcaataatgtgcataatcaaagaagaagtattagcatacgtagtacaactacccctatatggagtaatagacacaccctgctggaaactacacacatcccccctctgtacaacaaacactaaagaaggatcaaacatttgcctaacaagaacagaccgcggatggtactgcgacaacgcaggctccgtatctttctttccacaagccgaaacttgtaaagttcaatcaaacagagtattttgcgatacaatgaactccttaacattaccttcagaagtaaacctatgcaacatagacatcttcaacccaaaatacgactgcaaaataatgacctcaaaaacagacgtatcctcatcagtcataacctccttaggagcaatagtatcatgttacggaaaaacaaaatgtacagcatcaaataaaaatagaggaataataaaaaccttctccaacggatgcgactacgtatccaataaaggagtagacaccgtatcagtaggaaacacactatactgtgtaaacaaacaagaaggccaatctctatatgtaaaaggcgaaccaatcataaatttttacgacccacttgtcttcccctccgacgaatttgacgcaagcatatcacaagtaaacgaaaaaatcaaccaaagcctagccttcataaggaaatctgacgaattacttcataacgtaaatgttggaaaatcaaccacaaacataatgataaccaccatcataattgtaataatagtaatactactactactaattgcagtaggactcttcctatattgcaaagctcgctcaacaccagttaccttatcaaaagaccaactatctggaataaacaacatagccttttccaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14950 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut2 (opt11)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggaactcccaatcctaaaaaccaacgccatcaccaccatcctcgccgctgtcaccttatgctttgccagcagccaaaacatcaccgaagaattttaccaatcaacatgctccgccgtctcaaaaggatacctcggcgccctacgcaccggctggtacacaagcgtcataaccatcgagctctccaacatcaaggaaaacaaatgcaatggaaccgacgccaaagtcaaactaatcaaacaagaactagacaagtacaagaacgcagtcaccgacctccaactcctcatgcagtccacccccgcagcaggctctggctcagcaatatgctccggcatcgctgtctgcaaagtcctacacctcgaaggcgaagtcaacaaaatcaaaaacgccctactgtccacaaacaaagccgtcgtctccctatccaacggcgtctcggtcctaacctttaaggttctcgatctcaaaaattacatagacaaacaactactccccatcctcaacaaacaatcttgctcaatccccaacatcgaaaccgtcatcgagttccaacagaaaaacaacagactactcgaaatcacccgcgagttctcagtcaacgcgggcgtcacaacacccgtcagcacctacatgctaaccaactccgaactcctcagcctcattaacgacatgcccatcaccaacgaccaaaagaaacttatgtccaacaacgttcaaatcgtccgccaacaatcctactccatcatgtgcatcatcaaagaagaagtactcgcctacgtagtccaactgcccctctacggcgtcatcgataccccatgctggaaactacacaccagccccctctgcaccaccaacaccaaagaaggctccaatatctgcttaacccgcacagaccgtggctggtactgcgataacgccggctccgtctccttcttcccccaagcagaaacctgcaaagtacaatccaaccgagtcttctgtgacaccatgaactccctaacccttccatcagaagtcaacctctgcaacatcgacatcttcaaccccaagtacgactgcaaaatcatgacatccaaaaccgatgtctcaagcagcgtcataacctcactcggcgctatcgtaagctgctacggcaaaaccaaatgcaccgcatcaaacaaaaaccgcggaatcatcaaaaccttcagcaacggatgcgactacgtttccaacaaaggcgtagacaccgtctccgtcggaaacaccctctactgcgtaaacaaacaggaaggccaatccctctacgtcaaaggcgaacccatcataaacttctacgatccccttgtcttcccgtccgatgagttcgacgcctccatctcgcaagtcaacgaaaagataaaccaatcactagcattcatccgtaaatccgacgaactcctccacaacgtcaacgtcggaaaatccaccaccaacataatgatcaccaccataatcatcgtcatcatcgtaatactattactcctcatagccgtcggcctcttcctatattgcaaagcccgatcaacccccgtaaccctttctaaagaccaactgtccggaatcaacaacatcgctttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14951 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut2 (opt1)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14952 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut2 (opt1)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14953 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut2 (opt2)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14954 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut2 (opt3)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagatcaactcagtggcattaataacatcgcattctctaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14955 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut2 (opt4)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14956 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut2 (opt5)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagatcaactctctgggatcaataacattgctttctccaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14957 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut2 (opt6)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagcttccaatattaaaaacaaacgctataacaactatactcgcagcagttacactctgcttcgcatcctcacaaaacataactgaagaattttaccaatccacttgctcagccgtatcaaaaggatatctaggagcacttagaaccggatggtatacatcagtgataacaatagaactaagcaacataaaagaaaacaagtgcaacggaactgacgcaaaagtcaaactaatcaaacaagaactagacaaatacaaaaacgcagtaacagacctacaattactaatgcaatcaacaccagcagcaggatcaggttcagccatatgctcaggtatcgctgtatgcaaagtccttcacctagaaggtgaagtaaacaaaattaaaaacgccctactcagtacaaataaagctgtcgtaagtttatcaaacggagtatcagtccttacattcaaagtattagacctaaaaaattatatagacaaacaattactaccaatactcaacaaacaatcatgctcaataccaaatatagaaaccgtaatagaatttcagcaaaaaaataacagattactagaaataaccagagaattttcagtcaacgcaggagtcacaacacccgtctcaacctacatgctaaccaactcagaacttctatctcttatcaacgacatgcccataaccaatgatcaaaaaaaattaatgtctaataacgttcaaatagtaagacaacaatcatactcaataatgtgcataatcaaagaagaagtattagcatacgtagtacaactacccctatatggagtaatagacacaccctgctggaaactacacacatcccccctctgtacaacaaacactaaagaaggatcaaacatttgcctaacaagaacagaccgcggatggtactgcgacaacgcaggctccgtatctttctttccacaagccgaaacttgtaaagttcaatcaaacagagtattttgcgatacaatgaactccttaacattaccttcagaagtaaacctatgcaacatagacatcttcaacccaaaatacgactgcaaaataatgacctcaaaaacagacgtatcctcatcagtcataacctccttaggagcaatagtatcatgttacggaaaaacaaaatgtacagcatcaaataaaaatagaggaataataaaaaccttctccaacggatgcgactacgtatccaataaaggagtagacaccgtatcagtaggaaacacactatactgtgtaaacaaacaagaaggccaatctctatatgtaaaaggcgaaccaatcataaatttttacgacccacttgtcttcccctccgacgaatttgacgcaagcatatcacaagtaaacgaaaaaatcaaccaaagcctagccttcataaggaaatctgacgaattacttcataacgtaaatgttggaaaatcaaccacaaacataatgataaccaccatcataattgtaataatagtaatactactactactaattgcagtaggactcttcctatattgcaaagctcgctcaacaccagttaccttatcaaaagaccaactatctggaataaacaacatagccttttccaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14958 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut2 (opt11)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggaactcccaatcctaaaaaccaacgccatcaccaccatcctcgccgctgtcaccttatgctttgccagcagccaaaacatcaccgaagaattttaccaatcaacatgctccgccgtctcaaaaggatacctcggcgccctacgcaccggctggtacacaagcgtcataaccatcgagctctccaacatcaaggaaaacaaatgcaatggaaccgacgccaaagtcaaactaatcaaacaagaactagacaagtacaagaacgcagtcaccgacctccaactcctcatgcagtccacccccgcagcaggctctggctcagcaatatgctccggcatcgctgtctgcaaagtcctacacctcgaaggcgaagtcaacaaaatcaaaaacgccctactgtccacaaacaaagccgtcgtctccctatccaacggcgtctcggtcctaacctttaaggttctcgatctcaaaaattacatagacaaacaactactccccatcctcaacaaacaatcttgctcaatccccaacatcgaaaccgtcatcgagttccaacagaaaaacaacagactactcgaaatcacccgcgagttctcagtcaacgcgggcgtcacaacacccgtcagcacctacatgctaaccaactccgaactcctcagcctcattaacgacatgcccatcaccaacgaccaaaagaaacttatgtccaacaacgttcaaatcgtccgccaacaatcctactccatcatgtgcatcatcaaagaagaagtactcgcctacgtagtccaactgcccctctacggcgtcatcgataccccatgctggaaactacacaccagccccctctgcaccaccaacaccaaagaaggctccaatatctgcttaacccgcacagaccgtggctggtactgcgataacgccggctccgtctccttcttcccccaagcagaaacctgcaaagtacaatccaaccgagtcttctgtgacaccatgaactccctaacccttccatcagaagtcaacctctgcaacatcgacatcttcaaccccaagtacgactgcaaaatcatgacatccaaaaccgatgtctcaagcagcgtcataacctcactcggcgctatcgtaagctgctacggcaaaaccaaatgcaccgcatcaaacaaaaaccgcggaatcatcaaaaccttcagcaacggatgcgactacgtttccaacaaaggcgtagacaccgtctccgtcggaaacaccctctactgcgtaaacaaacaggaaggccaatccctctacgtcaaaggcgaacccatcataaacttctacgatccccttgtcttcccgtccgatgagttcgacgcctccatctcgcaagtcaacgaaaagataaaccaatcactagcattcatccgtaaatccgacgaactcctccacaacgtcaacgtcggaaaatccaccaccaacataatgatcaccaccataatcatcgtcatcatcgtaatactattactcctcatagccgtcggcctcttcctatattgcaaagcccgatcaacccccgtaaccctttctaaagaccaactgtccggaatcaacaacatcgctttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14959 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut2 (opt1)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14960 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut2 (opt1)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14961 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut2 (opt2)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14962 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut2 (opt3)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagatcaactcagtggcattaataacatcgcattctctaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14963 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut2 (opt4)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14964 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut2 (opt5)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagatcaactctctgggatcaataacattgctttctccaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14965 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut2 (opt6)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagcttccaatattaaaaacaaacgctataacaactatactcgcagcagttacactctgcttcgcatcctcacaaaacataactgaagaattttaccaatccacttgctcagccgtatcaaaaggatatctaggagcacttagaaccggatggtatacatcagtgataacaatagaactaagcaacataaaagaaaacaagtgcaacggaactgacgcaaaagtcaaactaatcaaacaagaactagacaaatacaaaaacgcagtaacagacctacaattactaatgcaatcaacaccagcagcaggatcaggttcagccatatgctcaggtatcgctgtatgcaaagtccttcacctagaaggtgaagtaaacaaaattaaaaacgccctactcagtacaaataaagctgtcgtaagtttatcaaacggagtatcagtccttacattcaaagtattagacctaaaaaattatatagacaaacaattactaccaatactcaacaaacaatcatgctcaataccaaatatagaaaccgtaatagaatttcagcaaaaaaataacagattactagaaataaccagagaattttcagtcaacgcaggagtcacaacacccgtctcaacctacatgctaaccaactcagaacttctatctcttatcaacgacatgcccataaccaatgatcaaaaaaaattaatgtctaataacgttcaaatagtaagacaacaatcatactcaataatgtgcataatcaaagaagaagtattagcatacgtagtacaactacccctatatggagtaatagacacaccctgctggaaactacacacatcccccctctgtacaacaaacactaaagaaggatcaaacatttgcctaacaagaacagaccgcggatggtactgcgacaacgcaggctccgtatctttctttccacaagccgaaacttgtaaagttcaatcaaacagagtattttgcgatacaatgaactccttaacattaccttcagaagtaaacctatgcaacatagacatcttcaacccaaaatacgactgcaaaataatgacctcaaaaacagacgtatcctcatcagtcataacctccttaggagcaatagtatcatgttacggaaaaacaaaatgtacagcatcaaataaaaatagaggaataataaaaaccttctccaacggatgcgactacgtatccaataaaggagtagacaccgtatcagtaggaaacacactatactgtgtaaacaaacaagaaggccaatctctatatgtaaaaggcgaaccaatcataaatttttacgacccacttgtcttcccctccgacgaatttgacgcaagcatatcacaagtaaacgaaaaaatcaaccaaagcctagccttcataaggaaatctgacgaattacttcataacgtaaatgttggaaaatcaaccacaaacataatgataaccaccatcataattgtaataatagtaatactactactactaattgcagtaggactcttcctatattgcaaagctcgctcaacaccagttaccttatcaaaagaccaactatctggaataaacaacatagccttttccaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14966 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut2 (opt11)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcccaatcctaaaaaccaacgccatcaccaccatcctcgccgctgtcaccttatgctttgccagcagccaaaacatcaccgaagaattttaccaatcaacatgctccgccgtctcaaaaggatacctcggcgccctacgcaccggctggtacacaagcgtcataaccatcgagctctccaacatcaaggaaaacaaatgcaatggaaccgacgccaaagtcaaactaatcaaacaagaactagacaagtacaagaacgcagtcaccgacctccaactcctcatgcagtccacccccgcagcaggctctggctcagcaatatgctccggcatcgctgtctgcaaagtcctacacctcgaaggcgaagtcaacaaaatcaaaaacgccctactgtccacaaacaaagccgtcgtctccctatccaacggcgtctcggtcctaacctttaaggttctcgatctcaaaaattacatagacaaacaactactccccatcctcaacaaacaatcttgctcaatccccaacatcgaaaccgtcatcgagttccaacagaaaaacaacagactactcgaaatcacccgcgagttctcagtcaacgcgggcgtcacaacacccgtcagcacctacatgctaaccaactccgaactcctcagcctcattaacgacatgcccatcaccaacgaccaaaagaaacttatgtccaacaacgttcaaatcgtccgccaacaatcctactccatcatgtgcatcatcaaagaagaagtactcgcctacgtagtccaactgcccctctacggcgtcatcgataccccatgctggaaactacacaccagccccctctgcaccaccaacaccaaagaaggctccaatatctgcttaacccgcacagaccgtggctggtactgcgataacgccggctccgtctccttcttcccccaagcagaaacctgcaaagtacaatccaaccgagtcttctgtgacaccatgaactccctaacccttccatcagaagtcaacctctgcaacatcgacatcttcaaccccaagtacgactgcaaaatcatgacatccaaaaccgatgtctcaagcagcgtcataacctcactcggcgctatcgtaagctgctacggcaaaaccaaatgcaccgcatcaaacaaaaaccgcggaatcatcaaaaccttcagcaacggatgcgactacgtttccaacaaaggcgtagacaccgtctccgtcggaaacaccctctactgcgtaaacaaacaggaaggccaatccctctacgtcaaaggcgaacccatcataaacttctacgatccccttgtcttcccgtccgatgagttcgacgcctccatctcgcaagtcaacgaaaagataaaccaatcactagcattcatccgtaaatccgacgaactcctccacaacgtcaacgtcggaaaatccaccaccaacataatgatcaccaccataatcatcgtcatcatcgtaatactattactcctcatagccgtcggcctcttcctatattgcaaagcccgatcaacccccgtaaccctttctaaagaccaactgtccggaatcaacaacatcgctttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14967 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut2 (opt1)
  source 1..1970: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14968 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut2 (opt1)
  source 1..1970: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14969 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut2 (opt2)
  source 1..1970: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14970 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut2 (opt3)
  source 1..1970: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagatcaactcagtggcattaataacatcgcattctctaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14971 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut2 (opt4)
  source 1..1970: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14972 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut2 (opt5)
  source 1..1970: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagatcaactctctgggatcaataacattgctttctccaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14973 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut2 (opt6)
  source 1..1970: mol_type = other RNA
gggagacccgtgacccggaagttgtacggctacgcgactttccctcccacaaaccctcgcgcccttcctttcctacttgggcccggcagaaagcttaccatggagcttccaatattaaaaacaaacgctataacaactatactcgcagcagttacactctgcttcgcatcctcacaaaacataactgaagaattttaccaatccacttgctcagccgtatcaaaaggatatctaggagcacttagaaccggatggtatacatcagtgataacaatagaactaagcaacataaaagaaaacaagtgcaacggaactgacgcaaaagtcaaactaatcaaacaagaactagacaaatacaaaaacgcagtaacagacctacaattactaatgcaatcaacaccagcagcaggatcaggttcagccatatgctcaggtatcgctgtatgcaaagtccttcacctagaaggtgaagtaaacaaaattaaaaacgccctactcagtacaaataaagctgtcgtaagtttatcaaacggagtatcagtccttacattcaaagtattagacctaaaaaattatatagacaaacaattactaccaatactcaacaaacaatcatgctcaataccaaatatagaaaccgtaatagaatttcagcaaaaaaataacagattactagaaataaccagagaattttcagtcaacgcaggagtcacaacacccgtctcaacctacatgctaaccaactcagaacttctatctcttatcaacgacatgcccataaccaatgatcaaaaaaaattaatgtctaataacgttcaaatagtaagacaacaatcatactcaataatgtgcataatcaaagaagaagtattagcatacgtagtacaactacccctatatggagtaatagacacaccctgctggaaactacacacatcccccctctgtacaacaaacactaaagaaggatcaaacatttgcctaacaagaacagaccgcggatggtactgcgacaacgcaggctccgtatctttctttccacaagccgaaacttgtaaagttcaatcaaacagagtattttgcgatacaatgaactccttaacattaccttcagaagtaaacctatgcaacatagacatcttcaacccaaaatacgactgcaaaataatgacctcaaaaacagacgtatcctcatcagtcataacctccttaggagcaatagtatcatgttacggaaaaacaaaatgtacagcatcaaataaaaatagaggaataataaaaaccttctccaacggatgcgactacgtatccaataaaggagtagacaccgtatcagtaggaaacacactatactgtgtaaacaaacaagaaggccaatctctatatgtaaaaggcgaaccaatcataaatttttacgacccacttgtcttcccctccgacgaatttgacgcaagcatatcacaagtaaacgaaaaaatcaaccaaagcctagccttcataaggaaatctgacgaattacttcataacgtaaatgttggaaaatcaaccacaaacataatgataaccaccatcataattgtaataatagtaatactactactactaattgcagtaggactcttcctatattgcaaagctcgctcaacaccagttaccttatcaaaagaccaactatctggaataaacaacatagccttttccaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14974 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut2 (opt11)
  source 1..1970: mol_type = other RNA
gggagacccgtgacccggaagttgtacggctacgcgactttccctcccacaaaccctcgcgcccttcctttcctacttgggcccggcagaaagcttaccatggaactcccaatcctaaaaaccaacgccatcaccaccatcctcgccgctgtcaccttatgctttgccagcagccaaaacatcaccgaagaattttaccaatcaacatgctccgccgtctcaaaaggatacctcggcgccctacgcaccggctggtacacaagcgtcataaccatcgagctctccaacatcaaggaaaacaaatgcaatggaaccgacgccaaagtcaaactaatcaaacaagaactagacaagtacaagaacgcagtcaccgacctccaactcctcatgcagtccacccccgcagcaggctctggctcagcaatatgctccggcatcgctgtctgcaaagtcctacacctcgaaggcgaagtcaacaaaatcaaaaacgccctactgtccacaaacaaagccgtcgtctccctatccaacggcgtctcggtcctaacctttaaggttctcgatctcaaaaattacatagacaaacaactactccccatcctcaacaaacaatcttgctcaatccccaacatcgaaaccgtcatcgagttccaacagaaaaacaacagactactcgaaatcacccgcgagttctcagtcaacgcgggcgtcacaacacccgtcagcacctacatgctaaccaactccgaactcctcagcctcattaacgacatgcccatcaccaacgaccaaaagaaacttatgtccaacaacgttcaaatcgtccgccaacaatcctactccatcatgtgcatcatcaaagaagaagtactcgcctacgtagtccaactgcccctctacggcgtcatcgataccccatgctggaaactacacaccagccccctctgcaccaccaacaccaaagaaggctccaatatctgcttaacccgcacagaccgtggctggtactgcgataacgccggctccgtctccttcttcccccaagcagaaacctgcaaagtacaatccaaccgagtcttctgtgacaccatgaactccctaacccttccatcagaagtcaacctctgcaacatcgacatcttcaaccccaagtacgactgcaaaatcatgacatccaaaaccgatgtctcaagcagcgtcataacctcactcggcgctatcgtaagctgctacggcaaaaccaaatgcaccgcatcaaacaaaaaccgcggaatcatcaaaaccttcagcaacggatgcgactacgtttccaacaaaggcgtagacaccgtctccgtcggaaacaccctctactgcgtaaacaaacaggaaggccaatccctctacgtcaaaggcgaacccatcataaacttctacgatccccttgtcttcccgtccgatgagttcgacgcctccatctcgcaagtcaacgaaaagataaaccaatcactagcattcatccgtaaatccgacgaactcctccacaacgtcaacgtcggaaaatccaccaccaacataatgatcaccaccataatcatcgtcatcatcgtaatactattactcctcatagccgtcggcctcttcctatattgcaaagcccgatcaacccccgtaaccctttctaaagaccaactgtccggaatcaacaacatcgctttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14975 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut2 (opt1)
  source 1..1986: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14976 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut2 (opt1)
  source 1..1986: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14977 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut2 (opt2)
  source 1..1986: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14978 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut2 (opt3)
  source 1..1986: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagatcaactcagtggcattaataacatcgcattctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14979 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut2 (opt4)
  source 1..1986: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14980 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut2 (opt5)
  source 1..1986: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagatcaactctctgggatcaataacattgctttctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14981 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut2 (opt6)
  source 1..1986: mol_type = other RNA
gggagacccgtgacccggaagttgtacggctacgcgactttccctcccacaaaccctcgcgcccttcctttcctacttgggcccggcagaaagcttaccatggagcttccaatattaaaaacaaacgctataacaactatactcgcagcagttacactctgcttcgcatcctcacaaaacataactgaagaattttaccaatccacttgctcagccgtatcaaaaggatatctaggagcacttagaaccggatggtatacatcagtgataacaatagaactaagcaacataaaagaaaacaagtgcaacggaactgacgcaaaagtcaaactaatcaaacaagaactagacaaatacaaaaacgcagtaacagacctacaattactaatgcaatcaacaccagcagcaggatcaggttcagccatatgctcaggtatcgctgtatgcaaagtccttcacctagaaggtgaagtaaacaaaattaaaaacgccctactcagtacaaataaagctgtcgtaagtttatcaaacggagtatcagtccttacattcaaagtattagacctaaaaaattatatagacaaacaattactaccaatactcaacaaacaatcatgctcaataccaaatatagaaaccgtaatagaatttcagcaaaaaaataacagattactagaaataaccagagaattttcagtcaacgcaggagtcacaacacccgtctcaacctacatgctaaccaactcagaacttctatctcttatcaacgacatgcccataaccaatgatcaaaaaaaattaatgtctaataacgttcaaatagtaagacaacaatcatactcaataatgtgcataatcaaagaagaagtattagcatacgtagtacaactacccctatatggagtaatagacacaccctgctggaaactacacacatcccccctctgtacaacaaacactaaagaaggatcaaacatttgcctaacaagaacagaccgcggatggtactgcgacaacgcaggctccgtatctttctttccacaagccgaaacttgtaaagttcaatcaaacagagtattttgcgatacaatgaactccttaacattaccttcagaagtaaacctatgcaacatagacatcttcaacccaaaatacgactgcaaaataatgacctcaaaaacagacgtatcctcatcagtcataacctccttaggagcaatagtatcatgttacggaaaaacaaaatgtacagcatcaaataaaaatagaggaataataaaaaccttctccaacggatgcgactacgtatccaataaaggagtagacaccgtatcagtaggaaacacactatactgtgtaaacaaacaagaaggccaatctctatatgtaaaaggcgaaccaatcataaatttttacgacccacttgtcttcccctccgacgaatttgacgcaagcatatcacaagtaaacgaaaaaatcaaccaaagcctagccttcataaggaaatctgacgaattacttcataacgtaaatgttggaaaatcaaccacaaacataatgataaccaccatcataattgtaataatagtaatactactactactaattgcagtaggactcttcctatattgcaaagctcgctcaacaccagttaccttatcaaaagaccaactatctggaataaacaacatagccttttccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14982 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut2 (opt11)
  source 1..1986: mol_type = other RNA
gggagacccgtgacccggaagttgtacggctacgcgactttccctcccacaaaccctcgcgcccttcctttcctacttgggcccggcagaaagcttaccatggaactcccaatcctaaaaaccaacgccatcaccaccatcctcgccgctgtcaccttatgctttgccagcagccaaaacatcaccgaagaattttaccaatcaacatgctccgccgtctcaaaaggatacctcggcgccctacgcaccggctggtacacaagcgtcataaccatcgagctctccaacatcaaggaaaacaaatgcaatggaaccgacgccaaagtcaaactaatcaaacaagaactagacaagtacaagaacgcagtcaccgacctccaactcctcatgcagtccacccccgcagcaggctctggctcagcaatatgctccggcatcgctgtctgcaaagtcctacacctcgaaggcgaagtcaacaaaatcaaaaacgccctactgtccacaaacaaagccgtcgtctccctatccaacggcgtctcggtcctaacctttaaggttctcgatctcaaaaattacatagacaaacaactactccccatcctcaacaaacaatcttgctcaatccccaacatcgaaaccgtcatcgagttccaacagaaaaacaacagactactcgaaatcacccgcgagttctcagtcaacgcgggcgtcacaacacccgtcagcacctacatgctaaccaactccgaactcctcagcctcattaacgacatgcccatcaccaacgaccaaaagaaacttatgtccaacaacgttcaaatcgtccgccaacaatcctactccatcatgtgcatcatcaaagaagaagtactcgcctacgtagtccaactgcccctctacggcgtcatcgataccccatgctggaaactacacaccagccccctctgcaccaccaacaccaaagaaggctccaatatctgcttaacccgcacagaccgtggctggtactgcgataacgccggctccgtctccttcttcccccaagcagaaacctgcaaagtacaatccaaccgagtcttctgtgacaccatgaactccctaacccttccatcagaagtcaacctctgcaacatcgacatcttcaaccccaagtacgactgcaaaatcatgacatccaaaaccgatgtctcaagcagcgtcataacctcactcggcgctatcgtaagctgctacggcaaaaccaaatgcaccgcatcaaacaaaaaccgcggaatcatcaaaaccttcagcaacggatgcgactacgtttccaacaaaggcgtagacaccgtctccgtcggaaacaccctctactgcgtaaacaaacaggaaggccaatccctctacgtcaaaggcgaacccatcataaacttctacgatccccttgtcttcccgtccgatgagttcgacgcctccatctcgcaagtcaacgaaaagataaaccaatcactagcattcatccgtaaatccgacgaactcctccacaacgtcaacgtcggaaaatccaccaccaacataatgatcaccaccataatcatcgtcatcatcgtaatactattactcctcatagccgtcggcctcttcctatattgcaaagcccgatcaacccccgtaaccctttctaaagaccaactgtccggaatcaacaacatcgctttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14983 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut2 (opt1)
  source 1..2202: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14984 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut2 (opt1)
  source 1..2202: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14985 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut2 (opt2)
  source 1..2202: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14986 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut2 (opt3)
  source 1..2202: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagatcaactcagtggcattaataacatcgcattctctaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14987 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut2 (opt4)
  source 1..2202: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14988 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut2 (opt5)
  source 1..2202: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagatcaactctctgggatcaataacattgctttctccaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14989 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut2 (opt6)
  source 1..2202: mol_type = other RNA
gggagacccgtgacccggaagttgtacggctacgcgactttccctcccacaaaccctcgcgcccttcctttcctacttgggcccggcagaaagcttaccatggagcttccaatattaaaaacaaacgctataacaactatactcgcagcagttacactctgcttcgcatcctcacaaaacataactgaagaattttaccaatccacttgctcagccgtatcaaaaggatatctaggagcacttagaaccggatggtatacatcagtgataacaatagaactaagcaacataaaagaaaacaagtgcaacggaactgacgcaaaagtcaaactaatcaaacaagaactagacaaatacaaaaacgcagtaacagacctacaattactaatgcaatcaacaccagcagcaggatcaggttcagccatatgctcaggtatcgctgtatgcaaagtccttcacctagaaggtgaagtaaacaaaattaaaaacgccctactcagtacaaataaagctgtcgtaagtttatcaaacggagtatcagtccttacattcaaagtattagacctaaaaaattatatagacaaacaattactaccaatactcaacaaacaatcatgctcaataccaaatatagaaaccgtaatagaatttcagcaaaaaaataacagattactagaaataaccagagaattttcagtcaacgcaggagtcacaacacccgtctcaacctacatgctaaccaactcagaacttctatctcttatcaacgacatgcccataaccaatgatcaaaaaaaattaatgtctaataacgttcaaatagtaagacaacaatcatactcaataatgtgcataatcaaagaagaagtattagcatacgtagtacaactacccctatatggagtaatagacacaccctgctggaaactacacacatcccccctctgtacaacaaacactaaagaaggatcaaacatttgcctaacaagaacagaccgcggatggtactgcgacaacgcaggctccgtatctttctttccacaagccgaaacttgtaaagttcaatcaaacagagtattttgcgatacaatgaactccttaacattaccttcagaagtaaacctatgcaacatagacatcttcaacccaaaatacgactgcaaaataatgacctcaaaaacagacgtatcctcatcagtcataacctccttaggagcaatagtatcatgttacggaaaaacaaaatgtacagcatcaaataaaaatagaggaataataaaaaccttctccaacggatgcgactacgtatccaataaaggagtagacaccgtatcagtaggaaacacactatactgtgtaaacaaacaagaaggccaatctctatatgtaaaaggcgaaccaatcataaatttttacgacccacttgtcttcccctccgacgaatttgacgcaagcatatcacaagtaaacgaaaaaatcaaccaaagcctagccttcataaggaaatctgacgaattacttcataacgtaaatgttggaaaatcaaccacaaacataatgataaccaccatcataattgtaataatagtaatactactactactaattgcagtaggactcttcctatattgcaaagctcgctcaacaccagttaccttatcaaaagaccaactatctggaataaacaacatagccttttccaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14990 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut2 (opt11)
  source 1..2202: mol_type = other RNA
gggagacccgtgacccggaagttgtacggctacgcgactttccctcccacaaaccctcgcgcccttcctttcctacttgggcccggcagaaagcttaccatggaactcccaatcctaaaaaccaacgccatcaccaccatcctcgccgctgtcaccttatgctttgccagcagccaaaacatcaccgaagaattttaccaatcaacatgctccgccgtctcaaaaggatacctcggcgccctacgcaccggctggtacacaagcgtcataaccatcgagctctccaacatcaaggaaaacaaatgcaatggaaccgacgccaaagtcaaactaatcaaacaagaactagacaagtacaagaacgcagtcaccgacctccaactcctcatgcagtccacccccgcagcaggctctggctcagcaatatgctccggcatcgctgtctgcaaagtcctacacctcgaaggcgaagtcaacaaaatcaaaaacgccctactgtccacaaacaaagccgtcgtctccctatccaacggcgtctcggtcctaacctttaaggttctcgatctcaaaaattacatagacaaacaactactccccatcctcaacaaacaatcttgctcaatccccaacatcgaaaccgtcatcgagttccaacagaaaaacaacagactactcgaaatcacccgcgagttctcagtcaacgcgggcgtcacaacacccgtcagcacctacatgctaaccaactccgaactcctcagcctcattaacgacatgcccatcaccaacgaccaaaagaaacttatgtccaacaacgttcaaatcgtccgccaacaatcctactccatcatgtgcatcatcaaagaagaagtactcgcctacgtagtccaactgcccctctacggcgtcatcgataccccatgctggaaactacacaccagccccctctgcaccaccaacaccaaagaaggctccaatatctgcttaacccgcacagaccgtggctggtactgcgataacgccggctccgtctccttcttcccccaagcagaaacctgcaaagtacaatccaaccgagtcttctgtgacaccatgaactccctaacccttccatcagaagtcaacctctgcaacatcgacatcttcaaccccaagtacgactgcaaaatcatgacatccaaaaccgatgtctcaagcagcgtcataacctcactcggcgctatcgtaagctgctacggcaaaaccaaatgcaccgcatcaaacaaaaaccgcggaatcatcaaaaccttcagcaacggatgcgactacgtttccaacaaaggcgtagacaccgtctccgtcggaaacaccctctactgcgtaaacaaacaggaaggccaatccctctacgtcaaaggcgaacccatcataaacttctacgatccccttgtcttcccgtccgatgagttcgacgcctccatctcgcaagtcaacgaaaagataaaccaatcactagcattcatccgtaaatccgacgaactcctccacaacgtcaacgtcggaaaatccaccaccaacataatgatcaccaccataatcatcgtcatcatcgtaatactattactcctcatagccgtcggcctcttcctatattgcaaagcccgatcaacccccgtaaccctttctaaagaccaactgtccggaatcaacaacatcgctttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14991 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut2 (opt1)
  source 1..1982: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14992 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut2 (opt1)
  source 1..1982: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14993 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut2 (opt2)
  source 1..1982: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14994 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut2 (opt3)
  source 1..1982: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagatcaactcagtggcattaataacatcgcattctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14995 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut2 (opt4)
  source 1..1982: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14996 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut2 (opt5)
  source 1..1982: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagatcaactctctgggatcaataacattgctttctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14997 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut2 (opt6)
  source 1..1982: mol_type = other RNA
gggagacccgtgacccggaagttgtacggctacgcgactttccctcccacaaaccctcgcgcccttcctttcctacttgggcccggcagaaagcttaccatggagcttccaatattaaaaacaaacgctataacaactatactcgcagcagttacactctgcttcgcatcctcacaaaacataactgaagaattttaccaatccacttgctcagccgtatcaaaaggatatctaggagcacttagaaccggatggtatacatcagtgataacaatagaactaagcaacataaaagaaaacaagtgcaacggaactgacgcaaaagtcaaactaatcaaacaagaactagacaaatacaaaaacgcagtaacagacctacaattactaatgcaatcaacaccagcagcaggatcaggttcagccatatgctcaggtatcgctgtatgcaaagtccttcacctagaaggtgaagtaaacaaaattaaaaacgccctactcagtacaaataaagctgtcgtaagtttatcaaacggagtatcagtccttacattcaaagtattagacctaaaaaattatatagacaaacaattactaccaatactcaacaaacaatcatgctcaataccaaatatagaaaccgtaatagaatttcagcaaaaaaataacagattactagaaataaccagagaattttcagtcaacgcaggagtcacaacacccgtctcaacctacatgctaaccaactcagaacttctatctcttatcaacgacatgcccataaccaatgatcaaaaaaaattaatgtctaataacgttcaaatagtaagacaacaatcatactcaataatgtgcataatcaaagaagaagtattagcatacgtagtacaactacccctatatggagtaatagacacaccctgctggaaactacacacatcccccctctgtacaacaaacactaaagaaggatcaaacatttgcctaacaagaacagaccgcggatggtactgcgacaacgcaggctccgtatctttctttccacaagccgaaacttgtaaagttcaatcaaacagagtattttgcgatacaatgaactccttaacattaccttcagaagtaaacctatgcaacatagacatcttcaacccaaaatacgactgcaaaataatgacctcaaaaacagacgtatcctcatcagtcataacctccttaggagcaatagtatcatgttacggaaaaacaaaatgtacagcatcaaataaaaatagaggaataataaaaaccttctccaacggatgcgactacgtatccaataaaggagtagacaccgtatcagtaggaaacacactatactgtgtaaacaaacaagaaggccaatctctatatgtaaaaggcgaaccaatcataaatttttacgacccacttgtcttcccctccgacgaatttgacgcaagcatatcacaagtaaacgaaaaaatcaaccaaagcctagccttcataaggaaatctgacgaattacttcataacgtaaatgttggaaaatcaaccacaaacataatgataaccaccatcataattgtaataatagtaatactactactactaattgcagtaggactcttcctatattgcaaagctcgctcaacaccagttaccttatcaaaagaccaactatctggaataaacaacatagccttttccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14998 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut2 (opt11)
  source 1..1982: mol_type = other RNA
gggagacccgtgacccggaagttgtacggctacgcgactttccctcccacaaaccctcgcgcccttcctttcctacttgggcccggcagaaagcttaccatggaactcccaatcctaaaaaccaacgccatcaccaccatcctcgccgctgtcaccttatgctttgccagcagccaaaacatcaccgaagaattttaccaatcaacatgctccgccgtctcaaaaggatacctcggcgccctacgcaccggctggtacacaagcgtcataaccatcgagctctccaacatcaaggaaaacaaatgcaatggaaccgacgccaaagtcaaactaatcaaacaagaactagacaagtacaagaacgcagtcaccgacctccaactcctcatgcagtccacccccgcagcaggctctggctcagcaatatgctccggcatcgctgtctgcaaagtcctacacctcgaaggcgaagtcaacaaaatcaaaaacgccctactgtccacaaacaaagccgtcgtctccctatccaacggcgtctcggtcctaacctttaaggttctcgatctcaaaaattacatagacaaacaactactccccatcctcaacaaacaatcttgctcaatccccaacatcgaaaccgtcatcgagttccaacagaaaaacaacagactactcgaaatcacccgcgagttctcagtcaacgcgggcgtcacaacacccgtcagcacctacatgctaaccaactccgaactcctcagcctcattaacgacatgcccatcaccaacgaccaaaagaaacttatgtccaacaacgttcaaatcgtccgccaacaatcctactccatcatgtgcatcatcaaagaagaagtactcgcctacgtagtccaactgcccctctacggcgtcatcgataccccatgctggaaactacacaccagccccctctgcaccaccaacaccaaagaaggctccaatatctgcttaacccgcacagaccgtggctggtactgcgataacgccggctccgtctccttcttcccccaagcagaaacctgcaaagtacaatccaaccgagtcttctgtgacaccatgaactccctaacccttccatcagaagtcaacctctgcaacatcgacatcttcaaccccaagtacgactgcaaaatcatgacatccaaaaccgatgtctcaagcagcgtcataacctcactcggcgctatcgtaagctgctacggcaaaaccaaatgcaccgcatcaaacaaaaaccgcggaatcatcaaaaccttcagcaacggatgcgactacgtttccaacaaaggcgtagacaccgtctccgtcggaaacaccctctactgcgtaaacaaacaggaaggccaatccctctacgtcaaaggcgaacccatcataaacttctacgatccccttgtcttcccgtccgatgagttcgacgcctccatctcgcaagtcaacgaaaagataaaccaatcactagcattcatccgtaaatccgacgaactcctccacaacgtcaacgtcggaaaatccaccaccaacataatgatcaccaccataatcatcgtcatcatcgtaatactattactcctcatagccgtcggcctcttcctatattgcaaagcccgatcaacccccgtaaccctttctaaagaccaactgtccggaatcaacaacatcgctttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14999 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut2 (opt1)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15000 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut2 (opt1)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15001 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut2 (opt2)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15002 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut2 (opt3)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagatcaactcagtggcattaataacatcgcattctctaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15003 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut2 (opt4)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15004 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut2 (opt5)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagatcaactctctgggatcaataacattgctttctccaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15005 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut2 (opt6)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagcttccaatattaaaaacaaacgctataacaactatactcgcagcagttacactctgcttcgcatcctcacaaaacataactgaagaattttaccaatccacttgctcagccgtatcaaaaggatatctaggagcacttagaaccggatggtatacatcagtgataacaatagaactaagcaacataaaagaaaacaagtgcaacggaactgacgcaaaagtcaaactaatcaaacaagaactagacaaatacaaaaacgcagtaacagacctacaattactaatgcaatcaacaccagcagcaggatcaggttcagccatatgctcaggtatcgctgtatgcaaagtccttcacctagaaggtgaagtaaacaaaattaaaaacgccctactcagtacaaataaagctgtcgtaagtttatcaaacggagtatcagtccttacattcaaagtattagacctaaaaaattatatagacaaacaattactaccaatactcaacaaacaatcatgctcaataccaaatatagaaaccgtaatagaatttcagcaaaaaaataacagattactagaaataaccagagaattttcagtcaacgcaggagtcacaacacccgtctcaacctacatgctaaccaactcagaacttctatctcttatcaacgacatgcccataaccaatgatcaaaaaaaattaatgtctaataacgttcaaatagtaagacaacaatcatactcaataatgtgcataatcaaagaagaagtattagcatacgtagtacaactacccctatatggagtaatagacacaccctgctggaaactacacacatcccccctctgtacaacaaacactaaagaaggatcaaacatttgcctaacaagaacagaccgcggatggtactgcgacaacgcaggctccgtatctttctttccacaagccgaaacttgtaaagttcaatcaaacagagtattttgcgatacaatgaactccttaacattaccttcagaagtaaacctatgcaacatagacatcttcaacccaaaatacgactgcaaaataatgacctcaaaaacagacgtatcctcatcagtcataacctccttaggagcaatagtatcatgttacggaaaaacaaaatgtacagcatcaaataaaaatagaggaataataaaaaccttctccaacggatgcgactacgtatccaataaaggagtagacaccgtatcagtaggaaacacactatactgtgtaaacaaacaagaaggccaatctctatatgtaaaaggcgaaccaatcataaatttttacgacccacttgtcttcccctccgacgaatttgacgcaagcatatcacaagtaaacgaaaaaatcaaccaaagcctagccttcataaggaaatctgacgaattacttcataacgtaaatgttggaaaatcaaccacaaacataatgataaccaccatcataattgtaataatagtaatactactactactaattgcagtaggactcttcctatattgcaaagctcgctcaacaccagttaccttatcaaaagaccaactatctggaataaacaacatagccttttccaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15006 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut2 (opt11)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccaatcctaaaaaccaacgccatcaccaccatcctcgccgctgtcaccttatgctttgccagcagccaaaacatcaccgaagaattttaccaatcaacatgctccgccgtctcaaaaggatacctcggcgccctacgcaccggctggtacacaagcgtcataaccatcgagctctccaacatcaaggaaaacaaatgcaatggaaccgacgccaaagtcaaactaatcaaacaagaactagacaagtacaagaacgcagtcaccgacctccaactcctcatgcagtccacccccgcagcaggctctggctcagcaatatgctccggcatcgctgtctgcaaagtcctacacctcgaaggcgaagtcaacaaaatcaaaaacgccctactgtccacaaacaaagccgtcgtctccctatccaacggcgtctcggtcctaacctttaaggttctcgatctcaaaaattacatagacaaacaactactccccatcctcaacaaacaatcttgctcaatccccaacatcgaaaccgtcatcgagttccaacagaaaaacaacagactactcgaaatcacccgcgagttctcagtcaacgcgggcgtcacaacacccgtcagcacctacatgctaaccaactccgaactcctcagcctcattaacgacatgcccatcaccaacgaccaaaagaaacttatgtccaacaacgttcaaatcgtccgccaacaatcctactccatcatgtgcatcatcaaagaagaagtactcgcctacgtagtccaactgcccctctacggcgtcatcgataccccatgctggaaactacacaccagccccctctgcaccaccaacaccaaagaaggctccaatatctgcttaacccgcacagaccgtggctggtactgcgataacgccggctccgtctccttcttcccccaagcagaaacctgcaaagtacaatccaaccgagtcttctgtgacaccatgaactccctaacccttccatcagaagtcaacctctgcaacatcgacatcttcaaccccaagtacgactgcaaaatcatgacatccaaaaccgatgtctcaagcagcgtcataacctcactcggcgctatcgtaagctgctacggcaaaaccaaatgcaccgcatcaaacaaaaaccgcggaatcatcaaaaccttcagcaacggatgcgactacgtttccaacaaaggcgtagacaccgtctccgtcggaaacaccctctactgcgtaaacaaacaggaaggccaatccctctacgtcaaaggcgaacccatcataaacttctacgatccccttgtcttcccgtccgatgagttcgacgcctccatctcgcaagtcaacgaaaagataaaccaatcactagcattcatccgtaaatccgacgaactcctccacaacgtcaacgtcggaaaatccaccaccaacataatgatcaccaccataatcatcgtcatcatcgtaatactattactcctcatagccgtcggcctcttcctatattgcaaagcccgatcaacccccgtaaccctttctaaagaccaactgtccggaatcaacaacatcgctttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15007 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut2 (opt1)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15008 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut2 (opt1)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15009 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut2 (opt2)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15010 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut2 (opt3)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagatcaactcagtggcattaataacatcgcattctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15011 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut2 (opt4)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15012 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut2 (opt5)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagatcaactctctgggatcaataacattgctttctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15013 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut2 (opt6)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagcttccaatattaaaaacaaacgctataacaactatactcgcagcagttacactctgcttcgcatcctcacaaaacataactgaagaattttaccaatccacttgctcagccgtatcaaaaggatatctaggagcacttagaaccggatggtatacatcagtgataacaatagaactaagcaacataaaagaaaacaagtgcaacggaactgacgcaaaagtcaaactaatcaaacaagaactagacaaatacaaaaacgcagtaacagacctacaattactaatgcaatcaacaccagcagcaggatcaggttcagccatatgctcaggtatcgctgtatgcaaagtccttcacctagaaggtgaagtaaacaaaattaaaaacgccctactcagtacaaataaagctgtcgtaagtttatcaaacggagtatcagtccttacattcaaagtattagacctaaaaaattatatagacaaacaattactaccaatactcaacaaacaatcatgctcaataccaaatatagaaaccgtaatagaatttcagcaaaaaaataacagattactagaaataaccagagaattttcagtcaacgcaggagtcacaacacccgtctcaacctacatgctaaccaactcagaacttctatctcttatcaacgacatgcccataaccaatgatcaaaaaaaattaatgtctaataacgttcaaatagtaagacaacaatcatactcaataatgtgcataatcaaagaagaagtattagcatacgtagtacaactacccctatatggagtaatagacacaccctgctggaaactacacacatcccccctctgtacaacaaacactaaagaaggatcaaacatttgcctaacaagaacagaccgcggatggtactgcgacaacgcaggctccgtatctttctttccacaagccgaaacttgtaaagttcaatcaaacagagtattttgcgatacaatgaactccttaacattaccttcagaagtaaacctatgcaacatagacatcttcaacccaaaatacgactgcaaaataatgacctcaaaaacagacgtatcctcatcagtcataacctccttaggagcaatagtatcatgttacggaaaaacaaaatgtacagcatcaaataaaaatagaggaataataaaaaccttctccaacggatgcgactacgtatccaataaaggagtagacaccgtatcagtaggaaacacactatactgtgtaaacaaacaagaaggccaatctctatatgtaaaaggcgaaccaatcataaatttttacgacccacttgtcttcccctccgacgaatttgacgcaagcatatcacaagtaaacgaaaaaatcaaccaaagcctagccttcataaggaaatctgacgaattacttcataacgtaaatgttggaaaatcaaccacaaacataatgataaccaccatcataattgtaataatagtaatactactactactaattgcagtaggactcttcctatattgcaaagctcgctcaacaccagttaccttatcaaaagaccaactatctggaataaacaacatagccttttccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15014 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut2 (opt11)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccaatcctaaaaaccaacgccatcaccaccatcctcgccgctgtcaccttatgctttgccagcagccaaaacatcaccgaagaattttaccaatcaacatgctccgccgtctcaaaaggatacctcggcgccctacgcaccggctggtacacaagcgtcataaccatcgagctctccaacatcaaggaaaacaaatgcaatggaaccgacgccaaagtcaaactaatcaaacaagaactagacaagtacaagaacgcagtcaccgacctccaactcctcatgcagtccacccccgcagcaggctctggctcagcaatatgctccggcatcgctgtctgcaaagtcctacacctcgaaggcgaagtcaacaaaatcaaaaacgccctactgtccacaaacaaagccgtcgtctccctatccaacggcgtctcggtcctaacctttaaggttctcgatctcaaaaattacatagacaaacaactactccccatcctcaacaaacaatcttgctcaatccccaacatcgaaaccgtcatcgagttccaacagaaaaacaacagactactcgaaatcacccgcgagttctcagtcaacgcgggcgtcacaacacccgtcagcacctacatgctaaccaactccgaactcctcagcctcattaacgacatgcccatcaccaacgaccaaaagaaacttatgtccaacaacgttcaaatcgtccgccaacaatcctactccatcatgtgcatcatcaaagaagaagtactcgcctacgtagtccaactgcccctctacggcgtcatcgataccccatgctggaaactacacaccagccccctctgcaccaccaacaccaaagaaggctccaatatctgcttaacccgcacagaccgtggctggtactgcgataacgccggctccgtctccttcttcccccaagcagaaacctgcaaagtacaatccaaccgagtcttctgtgacaccatgaactccctaacccttccatcagaagtcaacctctgcaacatcgacatcttcaaccccaagtacgactgcaaaatcatgacatccaaaaccgatgtctcaagcagcgtcataacctcactcggcgctatcgtaagctgctacggcaaaaccaaatgcaccgcatcaaacaaaaaccgcggaatcatcaaaaccttcagcaacggatgcgactacgtttccaacaaaggcgtagacaccgtctccgtcggaaacaccctctactgcgtaaacaaacaggaaggccaatccctctacgtcaaaggcgaacccatcataaacttctacgatccccttgtcttcccgtccgatgagttcgacgcctccatctcgcaagtcaacgaaaagataaaccaatcactagcattcatccgtaaatccgacgaactcctccacaacgtcaacgtcggaaaatccaccaccaacataatgatcaccaccataatcatcgtcatcatcgtaatactattactcctcatagccgtcggcctcttcctatattgcaaagcccgatcaacccccgtaaccctttctaaagaccaactgtccggaatcaacaacatcgctttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15015 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut2 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15016 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut2 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15017 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut2 (opt2)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15018 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut2 (opt3)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagatcaactcagtggcattaataacatcgcattctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15019 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut2 (opt4)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15020 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut2 (opt5)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagatcaactctctgggatcaataacattgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15021 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut2 (opt6)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagcttccaatattaaaaacaaacgctataacaactatactcgcagcagttacactctgcttcgcatcctcacaaaacataactgaagaattttaccaatccacttgctcagccgtatcaaaaggatatctaggagcacttagaaccggatggtatacatcagtgataacaatagaactaagcaacataaaagaaaacaagtgcaacggaactgacgcaaaagtcaaactaatcaaacaagaactagacaaatacaaaaacgcagtaacagacctacaattactaatgcaatcaacaccagcagcaggatcaggttcagccatatgctcaggtatcgctgtatgcaaagtccttcacctagaaggtgaagtaaacaaaattaaaaacgccctactcagtacaaataaagctgtcgtaagtttatcaaacggagtatcagtccttacattcaaagtattagacctaaaaaattatatagacaaacaattactaccaatactcaacaaacaatcatgctcaataccaaatatagaaaccgtaatagaatttcagcaaaaaaataacagattactagaaataaccagagaattttcagtcaacgcaggagtcacaacacccgtctcaacctacatgctaaccaactcagaacttctatctcttatcaacgacatgcccataaccaatgatcaaaaaaaattaatgtctaataacgttcaaatagtaagacaacaatcatactcaataatgtgcataatcaaagaagaagtattagcatacgtagtacaactacccctatatggagtaatagacacaccctgctggaaactacacacatcccccctctgtacaacaaacactaaagaaggatcaaacatttgcctaacaagaacagaccgcggatggtactgcgacaacgcaggctccgtatctttctttccacaagccgaaacttgtaaagttcaatcaaacagagtattttgcgatacaatgaactccttaacattaccttcagaagtaaacctatgcaacatagacatcttcaacccaaaatacgactgcaaaataatgacctcaaaaacagacgtatcctcatcagtcataacctccttaggagcaatagtatcatgttacggaaaaacaaaatgtacagcatcaaataaaaatagaggaataataaaaaccttctccaacggatgcgactacgtatccaataaaggagtagacaccgtatcagtaggaaacacactatactgtgtaaacaaacaagaaggccaatctctatatgtaaaaggcgaaccaatcataaatttttacgacccacttgtcttcccctccgacgaatttgacgcaagcatatcacaagtaaacgaaaaaatcaaccaaagcctagccttcataaggaaatctgacgaattacttcataacgtaaatgttggaaaatcaaccacaaacataatgataaccaccatcataattgtaataatagtaatactactactactaattgcagtaggactcttcctatattgcaaagctcgctcaacaccagttaccttatcaaaagaccaactatctggaataaacaacatagccttttccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15022 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut2 (opt11)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccaatcctaaaaaccaacgccatcaccaccatcctcgccgctgtcaccttatgctttgccagcagccaaaacatcaccgaagaattttaccaatcaacatgctccgccgtctcaaaaggatacctcggcgccctacgcaccggctggtacacaagcgtcataaccatcgagctctccaacatcaaggaaaacaaatgcaatggaaccgacgccaaagtcaaactaatcaaacaagaactagacaagtacaagaacgcagtcaccgacctccaactcctcatgcagtccacccccgcagcaggctctggctcagcaatatgctccggcatcgctgtctgcaaagtcctacacctcgaaggcgaagtcaacaaaatcaaaaacgccctactgtccacaaacaaagccgtcgtctccctatccaacggcgtctcggtcctaacctttaaggttctcgatctcaaaaattacatagacaaacaactactccccatcctcaacaaacaatcttgctcaatccccaacatcgaaaccgtcatcgagttccaacagaaaaacaacagactactcgaaatcacccgcgagttctcagtcaacgcgggcgtcacaacacccgtcagcacctacatgctaaccaactccgaactcctcagcctcattaacgacatgcccatcaccaacgaccaaaagaaacttatgtccaacaacgttcaaatcgtccgccaacaatcctactccatcatgtgcatcatcaaagaagaagtactcgcctacgtagtccaactgcccctctacggcgtcatcgataccccatgctggaaactacacaccagccccctctgcaccaccaacaccaaagaaggctccaatatctgcttaacccgcacagaccgtggctggtactgcgataacgccggctccgtctccttcttcccccaagcagaaacctgcaaagtacaatccaaccgagtcttctgtgacaccatgaactccctaacccttccatcagaagtcaacctctgcaacatcgacatcttcaaccccaagtacgactgcaaaatcatgacatccaaaaccgatgtctcaagcagcgtcataacctcactcggcgctatcgtaagctgctacggcaaaaccaaatgcaccgcatcaaacaaaaaccgcggaatcatcaaaaccttcagcaacggatgcgactacgtttccaacaaaggcgtagacaccgtctccgtcggaaacaccctctactgcgtaaacaaacaggaaggccaatccctctacgtcaaaggcgaacccatcataaacttctacgatccccttgtcttcccgtccgatgagttcgacgcctccatctcgcaagtcaacgaaaagataaaccaatcactagcattcatccgtaaatccgacgaactcctccacaacgtcaacgtcggaaaatccaccaccaacataatgatcaccaccataatcatcgtcatcatcgtaatactattactcctcatagccgtcggcctcttcctatattgcaaagcccgatcaacccccgtaaccctttctaaagaccaactgtccggaatcaacaacatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15023 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut2 (opt1)
  source 1..1994: mol_type = other RNA
gggagaggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15024 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut2 (opt1)
  source 1..1994: mol_type = other RNA
gggagaggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15025 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut2 (opt2)
  source 1..1994: mol_type = other RNA
gggagaggcgctgcctacggaggtggcagccatctccttctcggcatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15026 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut2 (opt3)
  source 1..1994: mol_type = other RNA
gggagaggcgctgcctacggaggtggcagccatctccttctcggcatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagatcaactcagtggcattaataacatcgcattctctaattgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15027 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut2 (opt4)
  source 1..1994: mol_type = other RNA
gggagaggcgctgcctacggaggtggcagccatctccttctcggcatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15028 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut2 (opt5)
  source 1..1994: mol_type = other RNA
gggagaggcgctgcctacggaggtggcagccatctccttctcggcatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagatcaactctctgggatcaataacattgctttctccaattgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15029 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut2 (opt6)
  source 1..1994: mol_type = other RNA
gggagaggcgctgcctacggaggtggcagccatctccttctcggcatcaagcttaccatggagcttccaatattaaaaacaaacgctataacaactatactcgcagcagttacactctgcttcgcatcctcacaaaacataactgaagaattttaccaatccacttgctcagccgtatcaaaaggatatctaggagcacttagaaccggatggtatacatcagtgataacaatagaactaagcaacataaaagaaaacaagtgcaacggaactgacgcaaaagtcaaactaatcaaacaagaactagacaaatacaaaaacgcagtaacagacctacaattactaatgcaatcaacaccagcagcaggatcaggttcagccatatgctcaggtatcgctgtatgcaaagtccttcacctagaaggtgaagtaaacaaaattaaaaacgccctactcagtacaaataaagctgtcgtaagtttatcaaacggagtatcagtccttacattcaaagtattagacctaaaaaattatatagacaaacaattactaccaatactcaacaaacaatcatgctcaataccaaatatagaaaccgtaatagaatttcagcaaaaaaataacagattactagaaataaccagagaattttcagtcaacgcaggagtcacaacacccgtctcaacctacatgctaaccaactcagaacttctatctcttatcaacgacatgcccataaccaatgatcaaaaaaaattaatgtctaataacgttcaaatagtaagacaacaatcatactcaataatgtgcataatcaaagaagaagtattagcatacgtagtacaactacccctatatggagtaatagacacaccctgctggaaactacacacatcccccctctgtacaacaaacactaaagaaggatcaaacatttgcctaacaagaacagaccgcggatggtactgcgacaacgcaggctccgtatctttctttccacaagccgaaacttgtaaagttcaatcaaacagagtattttgcgatacaatgaactccttaacattaccttcagaagtaaacctatgcaacatagacatcttcaacccaaaatacgactgcaaaataatgacctcaaaaacagacgtatcctcatcagtcataacctccttaggagcaatagtatcatgttacggaaaaacaaaatgtacagcatcaaataaaaatagaggaataataaaaaccttctccaacggatgcgactacgtatccaataaaggagtagacaccgtatcagtaggaaacacactatactgtgtaaacaaacaagaaggccaatctctatatgtaaaaggcgaaccaatcataaatttttacgacccacttgtcttcccctccgacgaatttgacgcaagcatatcacaagtaaacgaaaaaatcaaccaaagcctagccttcataaggaaatctgacgaattacttcataacgtaaatgttggaaaatcaaccacaaacataatgataaccaccatcataattgtaataatagtaatactactactactaattgcagtaggactcttcctatattgcaaagctcgctcaacaccagttaccttatcaaaagaccaactatctggaataaacaacatagccttttccaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15030 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut2 (opt11)
  source 1..1994: mol_type = other RNA
gggagaggcgctgcctacggaggtggcagccatctccttctcggcatcaagcttaccatggaactcccaatcctaaaaaccaacgccatcaccaccatcctcgccgctgtcaccttatgctttgccagcagccaaaacatcaccgaagaattttaccaatcaacatgctccgccgtctcaaaaggatacctcggcgccctacgcaccggctggtacacaagcgtcataaccatcgagctctccaacatcaaggaaaacaaatgcaatggaaccgacgccaaagtcaaactaatcaaacaagaactagacaagtacaagaacgcagtcaccgacctccaactcctcatgcagtccacccccgcagcaggctctggctcagcaatatgctccggcatcgctgtctgcaaagtcctacacctcgaaggcgaagtcaacaaaatcaaaaacgccctactgtccacaaacaaagccgtcgtctccctatccaacggcgtctcggtcctaacctttaaggttctcgatctcaaaaattacatagacaaacaactactccccatcctcaacaaacaatcttgctcaatccccaacatcgaaaccgtcatcgagttccaacagaaaaacaacagactactcgaaatcacccgcgagttctcagtcaacgcgggcgtcacaacacccgtcagcacctacatgctaaccaactccgaactcctcagcctcattaacgacatgcccatcaccaacgaccaaaagaaacttatgtccaacaacgttcaaatcgtccgccaacaatcctactccatcatgtgcatcatcaaagaagaagtactcgcctacgtagtccaactgcccctctacggcgtcatcgataccccatgctggaaactacacaccagccccctctgcaccaccaacaccaaagaaggctccaatatctgcttaacccgcacagaccgtggctggtactgcgataacgccggctccgtctccttcttcccccaagcagaaacctgcaaagtacaatccaaccgagtcttctgtgacaccatgaactccctaacccttccatcagaagtcaacctctgcaacatcgacatcttcaaccccaagtacgactgcaaaatcatgacatccaaaaccgatgtctcaagcagcgtcataacctcactcggcgctatcgtaagctgctacggcaaaaccaaatgcaccgcatcaaacaaaaaccgcggaatcatcaaaaccttcagcaacggatgcgactacgtttccaacaaaggcgtagacaccgtctccgtcggaaacaccctctactgcgtaaacaaacaggaaggccaatccctctacgtcaaaggcgaacccatcataaacttctacgatccccttgtcttcccgtccgatgagttcgacgcctccatctcgcaagtcaacgaaaagataaaccaatcactagcattcatccgtaaatccgacgaactcctccacaacgtcaacgtcggaaaatccaccaccaacataatgatcaccaccataatcatcgtcatcatcgtaatactattactcctcatagccgtcggcctcttcctatattgcaaagcccgatcaacccccgtaaccctttctaaagaccaactgtccggaatcaacaacatcgctttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15031 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut2 (opt1)
  source 1..1990: mol_type = other RNA
ggggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15032 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut2 (opt1)
  source 1..1990: mol_type = other RNA
ggggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15033 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut2 (opt2)
  source 1..1990: mol_type = other RNA
ggggcgctgcctacggaggtggcagccatctccttctcggcatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15034 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut2 (opt3)
  source 1..1990: mol_type = other RNA
ggggcgctgcctacggaggtggcagccatctccttctcggcatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagatcaactcagtggcattaataacatcgcattctctaattgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15035 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut2 (opt4)
  source 1..1990: mol_type = other RNA
ggggcgctgcctacggaggtggcagccatctccttctcggcatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15036 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut2 (opt5)
  source 1..1990: mol_type = other RNA
ggggcgctgcctacggaggtggcagccatctccttctcggcatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagatcaactctctgggatcaataacattgctttctccaattgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15037 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut2 (opt6)
  source 1..1990: mol_type = other RNA
ggggcgctgcctacggaggtggcagccatctccttctcggcatcaagcttaccatggagcttccaatattaaaaacaaacgctataacaactatactcgcagcagttacactctgcttcgcatcctcacaaaacataactgaagaattttaccaatccacttgctcagccgtatcaaaaggatatctaggagcacttagaaccggatggtatacatcagtgataacaatagaactaagcaacataaaagaaaacaagtgcaacggaactgacgcaaaagtcaaactaatcaaacaagaactagacaaatacaaaaacgcagtaacagacctacaattactaatgcaatcaacaccagcagcaggatcaggttcagccatatgctcaggtatcgctgtatgcaaagtccttcacctagaaggtgaagtaaacaaaattaaaaacgccctactcagtacaaataaagctgtcgtaagtttatcaaacggagtatcagtccttacattcaaagtattagacctaaaaaattatatagacaaacaattactaccaatactcaacaaacaatcatgctcaataccaaatatagaaaccgtaatagaatttcagcaaaaaaataacagattactagaaataaccagagaattttcagtcaacgcaggagtcacaacacccgtctcaacctacatgctaaccaactcagaacttctatctcttatcaacgacatgcccataaccaatgatcaaaaaaaattaatgtctaataacgttcaaatagtaagacaacaatcatactcaataatgtgcataatcaaagaagaagtattagcatacgtagtacaactacccctatatggagtaatagacacaccctgctggaaactacacacatcccccctctgtacaacaaacactaaagaaggatcaaacatttgcctaacaagaacagaccgcggatggtactgcgacaacgcaggctccgtatctttctttccacaagccgaaacttgtaaagttcaatcaaacagagtattttgcgatacaatgaactccttaacattaccttcagaagtaaacctatgcaacatagacatcttcaacccaaaatacgactgcaaaataatgacctcaaaaacagacgtatcctcatcagtcataacctccttaggagcaatagtatcatgttacggaaaaacaaaatgtacagcatcaaataaaaatagaggaataataaaaaccttctccaacggatgcgactacgtatccaataaaggagtagacaccgtatcagtaggaaacacactatactgtgtaaacaaacaagaaggccaatctctatatgtaaaaggcgaaccaatcataaatttttacgacccacttgtcttcccctccgacgaatttgacgcaagcatatcacaagtaaacgaaaaaatcaaccaaagcctagccttcataaggaaatctgacgaattacttcataacgtaaatgttggaaaatcaaccacaaacataatgataaccaccatcataattgtaataatagtaatactactactactaattgcagtaggactcttcctatattgcaaagctcgctcaacaccagttaccttatcaaaagaccaactatctggaataaacaacatagccttttccaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15038 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut2 (opt11)
  source 1..1990: mol_type = other RNA
ggggcgctgcctacggaggtggcagccatctccttctcggcatcaagcttaccatggaactcccaatcctaaaaaccaacgccatcaccaccatcctcgccgctgtcaccttatgctttgccagcagccaaaacatcaccgaagaattttaccaatcaacatgctccgccgtctcaaaaggatacctcggcgccctacgcaccggctggtacacaagcgtcataaccatcgagctctccaacatcaaggaaaacaaatgcaatggaaccgacgccaaagtcaaactaatcaaacaagaactagacaagtacaagaacgcagtcaccgacctccaactcctcatgcagtccacccccgcagcaggctctggctcagcaatatgctccggcatcgctgtctgcaaagtcctacacctcgaaggcgaagtcaacaaaatcaaaaacgccctactgtccacaaacaaagccgtcgtctccctatccaacggcgtctcggtcctaacctttaaggttctcgatctcaaaaattacatagacaaacaactactccccatcctcaacaaacaatcttgctcaatccccaacatcgaaaccgtcatcgagttccaacagaaaaacaacagactactcgaaatcacccgcgagttctcagtcaacgcgggcgtcacaacacccgtcagcacctacatgctaaccaactccgaactcctcagcctcattaacgacatgcccatcaccaacgaccaaaagaaacttatgtccaacaacgttcaaatcgtccgccaacaatcctactccatcatgtgcatcatcaaagaagaagtactcgcctacgtagtccaactgcccctctacggcgtcatcgataccccatgctggaaactacacaccagccccctctgcaccaccaacaccaaagaaggctccaatatctgcttaacccgcacagaccgtggctggtactgcgataacgccggctccgtctccttcttcccccaagcagaaacctgcaaagtacaatccaaccgagtcttctgtgacaccatgaactccctaacccttccatcagaagtcaacctctgcaacatcgacatcttcaaccccaagtacgactgcaaaatcatgacatccaaaaccgatgtctcaagcagcgtcataacctcactcggcgctatcgtaagctgctacggcaaaaccaaatgcaccgcatcaaacaaaaaccgcggaatcatcaaaaccttcagcaacggatgcgactacgtttccaacaaaggcgtagacaccgtctccgtcggaaacaccctctactgcgtaaacaaacaggaaggccaatccctctacgtcaaaggcgaacccatcataaacttctacgatccccttgtcttcccgtccgatgagttcgacgcctccatctcgcaagtcaacgaaaagataaaccaatcactagcattcatccgtaaatccgacgaactcctccacaacgtcaacgtcggaaaatccaccaccaacataatgatcaccaccataatcatcgtcatcatcgtaatactattactcctcatagccgtcggcctcttcctatattgcaaagcccgatcaacccccgtaaccctttctaaagaccaactgtccggaatcaacaacatcgctttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15039 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut2 (opt1)
  source 1..1825: mol_type = other RNA
gggagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15040 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut2 (opt1)
  source 1..1825: mol_type = other RNA
gggagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15041 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut2 (opt2)
  source 1..1825: mol_type = other RNA
gggagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15042 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut2 (opt3)
  source 1..1825: mol_type = other RNA
gggagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctccacccctgtcacactgtcaaaagatcaactcagtggcattaataacatcgcattctctaattgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15043 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut2 (opt4)
  source 1..1825: mol_type = other RNA
gggagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15044 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut2 (opt5)
  source 1..1825: mol_type = other RNA
gggagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatccaccccggtgacacttagcaaagatcaactctctgggatcaataacattgctttctccaattgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15045 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut2 (opt6)
  source 1..1825: mol_type = other RNA
gggagaaagcttaccatggagcttccaatattaaaaacaaacgctataacaactatactcgcagcagttacactctgcttcgcatcctcacaaaacataactgaagaattttaccaatccacttgctcagccgtatcaaaaggatatctaggagcacttagaaccggatggtatacatcagtgataacaatagaactaagcaacataaaagaaaacaagtgcaacggaactgacgcaaaagtcaaactaatcaaacaagaactagacaaatacaaaaacgcagtaacagacctacaattactaatgcaatcaacaccagcagcaggatcaggttcagccatatgctcaggtatcgctgtatgcaaagtccttcacctagaaggtgaagtaaacaaaattaaaaacgccctactcagtacaaataaagctgtcgtaagtttatcaaacggagtatcagtccttacattcaaagtattagacctaaaaaattatatagacaaacaattactaccaatactcaacaaacaatcatgctcaataccaaatatagaaaccgtaatagaatttcagcaaaaaaataacagattactagaaataaccagagaattttcagtcaacgcaggagtcacaacacccgtctcaacctacatgctaaccaactcagaacttctatctcttatcaacgacatgcccataaccaatgatcaaaaaaaattaatgtctaataacgttcaaatagtaagacaacaatcatactcaataatgtgcataatcaaagaagaagtattagcatacgtagtacaactacccctatatggagtaatagacacaccctgctggaaactacacacatcccccctctgtacaacaaacactaaagaaggatcaaacatttgcctaacaagaacagaccgcggatggtactgcgacaacgcaggctccgtatctttctttccacaagccgaaacttgtaaagttcaatcaaacagagtattttgcgatacaatgaactccttaacattaccttcagaagtaaacctatgcaacatagacatcttcaacccaaaatacgactgcaaaataatgacctcaaaaacagacgtatcctcatcagtcataacctccttaggagcaatagtatcatgttacggaaaaacaaaatgtacagcatcaaataaaaatagaggaataataaaaaccttctccaacggatgcgactacgtatccaataaaggagtagacaccgtatcagtaggaaacacactatactgtgtaaacaaacaagaaggccaatctctatatgtaaaaggcgaaccaatcataaatttttacgacccacttgtcttcccctccgacgaatttgacgcaagcatatcacaagtaaacgaaaaaatcaaccaaagcctagccttcataaggaaatctgacgaattacttcataacgtaaatgttggaaaatcaaccacaaacataatgataaccaccatcataattgtaataatagtaatactactactactaattgcagtaggactcttcctatattgcaaagctcgctcaacaccagttaccttatcaaaagaccaactatctggaataaacaacatagccttttccaactaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15046 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut2 (opt11)
  source 1..1825: mol_type = other RNA
gggagaaagcttaccatggaactcccaatcctaaaaaccaacgccatcaccaccatcctcgccgctgtcaccttatgctttgccagcagccaaaacatcaccgaagaattttaccaatcaacatgctccgccgtctcaaaaggatacctcggcgccctacgcaccggctggtacacaagcgtcataaccatcgagctctccaacatcaaggaaaacaaatgcaatggaaccgacgccaaagtcaaactaatcaaacaagaactagacaagtacaagaacgcagtcaccgacctccaactcctcatgcagtccacccccgcagcaggctctggctcagcaatatgctccggcatcgctgtctgcaaagtcctacacctcgaaggcgaagtcaacaaaatcaaaaacgccctactgtccacaaacaaagccgtcgtctccctatccaacggcgtctcggtcctaacctttaaggttctcgatctcaaaaattacatagacaaacaactactccccatcctcaacaaacaatcttgctcaatccccaacatcgaaaccgtcatcgagttccaacagaaaaacaacagactactcgaaatcacccgcgagttctcagtcaacgcgggcgtcacaacacccgtcagcacctacatgctaaccaactccgaactcctcagcctcattaacgacatgcccatcaccaacgaccaaaagaaacttatgtccaacaacgttcaaatcgtccgccaacaatcctactccatcatgtgcatcatcaaagaagaagtactcgcctacgtagtccaactgcccctctacggcgtcatcgataccccatgctggaaactacacaccagccccctctgcaccaccaacaccaaagaaggctccaatatctgcttaacccgcacagaccgtggctggtactgcgataacgccggctccgtctccttcttcccccaagcagaaacctgcaaagtacaatccaaccgagtcttctgtgacaccatgaactccctaacccttccatcagaagtcaacctctgcaacatcgacatcttcaaccccaagtacgactgcaaaatcatgacatccaaaaccgatgtctcaagcagcgtcataacctcactcggcgctatcgtaagctgctacggcaaaaccaaatgcaccgcatcaaacaaaaaccgcggaatcatcaaaaccttcagcaacggatgcgactacgtttccaacaaaggcgtagacaccgtctccgtcggaaacaccctctactgcgtaaacaaacaggaaggccaatccctctacgtcaaaggcgaacccatcataaacttctacgatccccttgtcttcccgtccgatgagttcgacgcctccatctcgcaagtcaacgaaaagataaaccaatcactagcattcatccgtaaatccgacgaactcctccacaacgtcaacgtcggaaaatccaccaccaacataatgatcaccaccataatcatcgtcatcatcgtaatactattactcctcatagccgtcggcctcttcctatattgcaaagcccgatcaacccccgtaaccctttctaaagaccaactgtccggaatcaacaacatcgctttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15047 - protein, 514 aa, synthetic construct
  REGION 1..514: note = derived and/or modified protein sequence (artificial) from HRSV(Memphis-37)__AIY60640.1__F-del_DSCav1_mut2
MELPILKTNAITTILAAVTLCFASSQNITEEFYQSTCSAVSKGYLGALRTGWYTSVITIELSNIKENKCNGTDAKVKLIKQELDKYKNAVTDLQLLMQSTPAAGSGSAICSGIAVCKVLHLEGEVNKIKNALLSTNKAVVSLSNGVSVLTFKVLDLKNYIDKQLLPILNKQSCSIPNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYCVNKQEGQSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 15048 - RNA, 1545 nt, synthetic construct
  misc_feature 1..1545: note = derived and/or modified CDS sequence (opt1) from HRSV(Memphis-37)__AIY60640.1__F-del_DSCav1_mut2
  source 1..1545: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctga

SEQ ID NO: 15049 - RNA, 1545 nt, synthetic construct
  misc_feature 1..1545: note = derived and/or modified CDS sequence (opt1) from HRSV(Memphis-37)__AIY60640.1__F-del_DSCav1_mut2
  source 1..1545: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtga

SEQ ID NO: 15050 - RNA, 1545 nt, synthetic construct
  misc_feature 1..1545: note = derived and/or modified CDS sequence (opt2) from HRSV(Memphis-37)__AIY60640.1__F-del_DSCav1_mut2
  source 1..1545: mol_type = other RNA
atggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctga

SEQ ID NO: 15051 - RNA, 1545 nt, synthetic construct
  misc_feature 1..1545: note = derived and/or modified CDS sequence (opt3) from HRSV(Memphis-37)__AIY60640.1__F-del_DSCav1_mut2
  source 1..1545: mol_type = other RNA
atggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctga

SEQ ID NO: 15052 - RNA, 1545 nt, synthetic construct
  misc_feature 1..1545: note = derived and/or modified CDS sequence (opt4) from HRSV(Memphis-37)__AIY60640.1__F-del_DSCav1_mut2
  source 1..1545: mol_type = other RNA
atggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatga

SEQ ID NO: 15053 - RNA, 1545 nt, synthetic construct
  misc_feature 1..1545: note = derived and/or modified CDS sequence (opt5) from HRSV(Memphis-37)__AIY60640.1__F-del_DSCav1_mut2
  source 1..1545: mol_type = other RNA
atggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatga

SEQ ID NO: 15054 - RNA, 1545 nt, synthetic construct
  misc_feature 1..1545: note = derived and/or modified CDS sequence (opt6) from HRSV(Memphis-37)__AIY60640.1__F-del_DSCav1_mut2
  source 1..1545: mol_type = other RNA
atggaactaccaatactcaaaacaaacgcaataacaacaattttagctgcagtaacactttgtttcgcatcctcccaaaatataacagaagaattttatcaatcaacctgctcagccgtctccaaaggatatctaggtgcactacgcactggatggtacacaagtgtcatcacaatagaactttccaacatcaaagaaaataaatgtaatggaactgacgcaaaagtaaaactcataaaacaagaactagacaaatacaaaaacgcagtaacagacctacaactattaatgcaatcaacaccagcagcaggatccggcagtgccatatgctctggaatagcagtctgcaaagttttacacttagaaggcgaagtaaacaaaatcaaaaacgccctactatctacaaataaagccgtcgtatctctctcaaatggagtatcagtactaacattcaaagtattagacttaaaaaactacatcgataaacaattattgccaatattaaacaaacaatcttgctcaataccaaatatagaaacagtcatagaatttcaacaaaaaaataaccgattattagaaataacacgagaattttcagtaaatgccggagtcaccacaccagtatcaacatacatgctaacaaattcagaactattatcattaataaacgacatgcctattacaaatgatcaaaaaaaactaatgtccaacaatgtacaaatagtccgacaacaaagctactcaatcatgtgtataataaaagaagaagtacttgcatacgtagtacaattaccactatacggagttatcgacacaccatgctggaaactccacacttcaccactctgcaccacaaacacaaaagaaggctcaaacatatgcctaacaagaacagaccgaggatggtactgcgacaacgcaggatcagtatcattcttcccacaagcagaaacttgcaaagtacaatctaacagagttttctgtgacaccatgaatagcctaacactcccctccgaagttaacctatgtaacatagatatatttaatcccaaatatgattgcaaaatcatgacatctaaaaccgacgtatcatcatctgtaatcacatcactaggtgccatagtctcatgctacggcaaaacaaaatgcaccgcctcaaacaaaaaccgaggtataataaaaaccttcagtaatggatgtgactacgtatcaaacaaaggtgttgataccgtaagcgtcggcaacaccctatactgcgtaaataaacaagaaggccaatcactatacgtcaaaggcgaaccaattattaacttctatgacccactcgtctttccctccgacgaatttgacgcaagcatatcacaagtaaacgaaaaaataaaccaatcactagcattcatacgcaaatcagatgaactactacataacgtaaacgtaggaaaatccactacaaatataatgatcacaacaataataatcgtaattatagtcatattattactactaatagcagtaggacttttcctatactgtaaagcaagataa

SEQ ID NO: 15055 - RNA, 1545 nt, synthetic construct
  misc_feature 1..1545: note = derived and/or modified CDS sequence (opt11) from HRSV(Memphis-37)__AIY60640.1__F-del_DSCav1_mut2
  source 1..1545: mol_type = other RNA
atggaacttcccatcctcaagaccaacgctattacgaccatcctcgccgcagtcaccctctgcttcgcgtcatcccaaaacatcaccgaagaattttaccaatccacatgctccgcagtctcaaaaggctacctaggagccctacgcaccggatggtacacatccgtcatcacaatcgaactctccaacataaaagaaaacaaatgcaacggcaccgatgccaaagtaaaactgattaaacaagaactcgacaaatacaagaacgccgtcacagacctacagctcctcatgcaatcaactcccgccgccggcagcggatccgctatctgctcaggcatcgccgtatgcaaagtcctccacctagaaggcgaagtaaacaaaatcaagaacgcactactctcaacaaacaaagccgtcgtctccctctccaacggcgtctccgtccttaccttcaaagtcctcgaccttaagaactacattgacaaacaactcctacccatcctcaacaaacaatcctgctctatacctaatatagaaaccgtaatcgaatttcaacagaaaaacaaccgcctcctcgaaattacccgcgagttctcagtaaacgccggcgtaaccacccccgtctccacctacatgctcacaaattcagaactcctcagcctcatcaacgacatgcccataaccaacgaccaaaagaaactcatgtcaaacaacgtccaaatcgtcaggcaacaaagctacagcatcatgtgcatcattaaagaagaagtactcgcctacgtcgtgcaactacccctctacggcgtcatagacacaccctgctggaaacttcacacatcaccgctctgcaccacaaacaccaaagaaggcagtaacatatgcctcacccgaaccgaccgcggatggtactgcgacaacgccggatccgtcagcttcttcccacaagccgaaacctgcaaagtacaatccaaccgagtcttctgcgacaccatgaactctcttacgctcccctcagaagtcaacctatgcaacatcgacatcttcaaccccaaatacgactgcaaaatcatgacctccaaaacagacgtctcctcctcagtgataacctccctcggcgccattgtctcctgctacggcaaaaccaaatgcaccgcctccaacaaaaaccgtgggatcatcaaaaccttctcaaacggctgcgactacgtatccaataagggtgtcgacacagtctccgtaggcaataccctctattgcgtcaacaaacaagaaggccaatccctctacgtcaaaggcgaacctatcatcaacttctacgacccgctagtcttcccctcagacgagttcgacgcatccatctcacaagtcaacgaaaagatcaaccagtccctcgcattcatccgaaaatccgacgaacttctccacaacgttaacgtcggcaaatccaccactaacataatgatcaccacgatcatcatagtaattatcgtcatactcctcctcctaatcgctgtcggactcttcctctactgcaaggcccgctaa

SEQ ID NO: 15056 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut2 (opt1)
  source 1..1821: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15057 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut2 (opt1)
  source 1..1821: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15058 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut2 (opt2)
  source 1..1821: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15059 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut2 (opt3)
  source 1..1821: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15060 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut2 (opt4)
  source 1..1821: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15061 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut2 (opt5)
  source 1..1821: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15062 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut2 (opt6)
  source 1..1821: mol_type = other RNA
gggagagtcccgcagtcggcgtccagcggctctgcttgttcgtgtgtgtgtcgttgcaggccttattcaagcttaccatggaactaccaatactcaaaacaaacgcaataacaacaattttagctgcagtaacactttgtttcgcatcctcccaaaatataacagaagaattttatcaatcaacctgctcagccgtctccaaaggatatctaggtgcactacgcactggatggtacacaagtgtcatcacaatagaactttccaacatcaaagaaaataaatgtaatggaactgacgcaaaagtaaaactcataaaacaagaactagacaaatacaaaaacgcagtaacagacctacaactattaatgcaatcaacaccagcagcaggatccggcagtgccatatgctctggaatagcagtctgcaaagttttacacttagaaggcgaagtaaacaaaatcaaaaacgccctactatctacaaataaagccgtcgtatctctctcaaatggagtatcagtactaacattcaaagtattagacttaaaaaactacatcgataaacaattattgccaatattaaacaaacaatcttgctcaataccaaatatagaaacagtcatagaatttcaacaaaaaaataaccgattattagaaataacacgagaattttcagtaaatgccggagtcaccacaccagtatcaacatacatgctaacaaattcagaactattatcattaataaacgacatgcctattacaaatgatcaaaaaaaactaatgtccaacaatgtacaaatagtccgacaacaaagctactcaatcatgtgtataataaaagaagaagtacttgcatacgtagtacaattaccactatacggagttatcgacacaccatgctggaaactccacacttcaccactctgcaccacaaacacaaaagaaggctcaaacatatgcctaacaagaacagaccgaggatggtactgcgacaacgcaggatcagtatcattcttcccacaagcagaaacttgcaaagtacaatctaacagagttttctgtgacaccatgaatagcctaacactcccctccgaagttaacctatgtaacatagatatatttaatcccaaatatgattgcaaaatcatgacatctaaaaccgacgtatcatcatctgtaatcacatcactaggtgccatagtctcatgctacggcaaaacaaaatgcaccgcctcaaacaaaaaccgaggtataataaaaaccttcagtaatggatgtgactacgtatcaaacaaaggtgttgataccgtaagcgtcggcaacaccctatactgcgtaaataaacaagaaggccaatcactatacgtcaaaggcgaaccaattattaacttctatgacccactcgtctttccctccgacgaatttgacgcaagcatatcacaagtaaacgaaaaaataaaccaatcactagcattcatacgcaaatcagatgaactactacataacgtaaacgtaggaaaatccactacaaatataatgatcacaacaataataatcgtaattatagtcatattattactactaatagcagtaggacttttcctatactgtaaagcaagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15063 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut2 (opt11)
  source 1..1821: mol_type = other RNA
gggagagtcccgcagtcggcgtccagcggctctgcttgttcgtgtgtgtgtcgttgcaggccttattcaagcttaccatggaacttcccatcctcaagaccaacgctattacgaccatcctcgccgcagtcaccctctgcttcgcgtcatcccaaaacatcaccgaagaattttaccaatccacatgctccgcagtctcaaaaggctacctaggagccctacgcaccggatggtacacatccgtcatcacaatcgaactctccaacataaaagaaaacaaatgcaacggcaccgatgccaaagtaaaactgattaaacaagaactcgacaaatacaagaacgccgtcacagacctacagctcctcatgcaatcaactcccgccgccggcagcggatccgctatctgctcaggcatcgccgtatgcaaagtcctccacctagaaggcgaagtaaacaaaatcaagaacgcactactctcaacaaacaaagccgtcgtctccctctccaacggcgtctccgtccttaccttcaaagtcctcgaccttaagaactacattgacaaacaactcctacccatcctcaacaaacaatcctgctctatacctaatatagaaaccgtaatcgaatttcaacagaaaaacaaccgcctcctcgaaattacccgcgagttctcagtaaacgccggcgtaaccacccccgtctccacctacatgctcacaaattcagaactcctcagcctcatcaacgacatgcccataaccaacgaccaaaagaaactcatgtcaaacaacgtccaaatcgtcaggcaacaaagctacagcatcatgtgcatcattaaagaagaagtactcgcctacgtcgtgcaactacccctctacggcgtcatagacacaccctgctggaaacttcacacatcaccgctctgcaccacaaacaccaaagaaggcagtaacatatgcctcacccgaaccgaccgcggatggtactgcgacaacgccggatccgtcagcttcttcccacaagccgaaacctgcaaagtacaatccaaccgagtcttctgcgacaccatgaactctcttacgctcccctcagaagtcaacctatgcaacatcgacatcttcaaccccaaatacgactgcaaaatcatgacctccaaaacagacgtctcctcctcagtgataacctccctcggcgccattgtctcctgctacggcaaaaccaaatgcaccgcctccaacaaaaaccgtgggatcatcaaaaccttctcaaacggctgcgactacgtatccaataagggtgtcgacacagtctccgtaggcaataccctctattgcgtcaacaaacaagaaggccaatccctctacgtcaaaggcgaacctatcatcaacttctacgacccgctagtcttcccctcagacgagttcgacgcatccatctcacaagtcaacgaaaagatcaaccagtccctcgcattcatccgaaaatccgacgaacttctccacaacgttaacgtcggcaaatccaccactaacataatgatcaccacgatcatcatagtaattatcgtcatactcctcctcctaatcgctgtcggactcttcctctactgcaaggcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15064 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut2 (opt1)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15065 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut2 (opt1)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15066 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut2 (opt2)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15067 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut2 (opt3)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15068 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut2 (opt4)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15069 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut2 (opt5)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15070 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut2 (opt6)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggaactaccaatactcaaaacaaacgcaataacaacaattttagctgcagtaacactttgtttcgcatcctcccaaaatataacagaagaattttatcaatcaacctgctcagccgtctccaaaggatatctaggtgcactacgcactggatggtacacaagtgtcatcacaatagaactttccaacatcaaagaaaataaatgtaatggaactgacgcaaaagtaaaactcataaaacaagaactagacaaatacaaaaacgcagtaacagacctacaactattaatgcaatcaacaccagcagcaggatccggcagtgccatatgctctggaatagcagtctgcaaagttttacacttagaaggcgaagtaaacaaaatcaaaaacgccctactatctacaaataaagccgtcgtatctctctcaaatggagtatcagtactaacattcaaagtattagacttaaaaaactacatcgataaacaattattgccaatattaaacaaacaatcttgctcaataccaaatatagaaacagtcatagaatttcaacaaaaaaataaccgattattagaaataacacgagaattttcagtaaatgccggagtcaccacaccagtatcaacatacatgctaacaaattcagaactattatcattaataaacgacatgcctattacaaatgatcaaaaaaaactaatgtccaacaatgtacaaatagtccgacaacaaagctactcaatcatgtgtataataaaagaagaagtacttgcatacgtagtacaattaccactatacggagttatcgacacaccatgctggaaactccacacttcaccactctgcaccacaaacacaaaagaaggctcaaacatatgcctaacaagaacagaccgaggatggtactgcgacaacgcaggatcagtatcattcttcccacaagcagaaacttgcaaagtacaatctaacagagttttctgtgacaccatgaatagcctaacactcccctccgaagttaacctatgtaacatagatatatttaatcccaaatatgattgcaaaatcatgacatctaaaaccgacgtatcatcatctgtaatcacatcactaggtgccatagtctcatgctacggcaaaacaaaatgcaccgcctcaaacaaaaaccgaggtataataaaaaccttcagtaatggatgtgactacgtatcaaacaaaggtgttgataccgtaagcgtcggcaacaccctatactgcgtaaataaacaagaaggccaatcactatacgtcaaaggcgaaccaattattaacttctatgacccactcgtctttccctccgacgaatttgacgcaagcatatcacaagtaaacgaaaaaataaaccaatcactagcattcatacgcaaatcagatgaactactacataacgtaaacgtaggaaaatccactacaaatataatgatcacaacaataataatcgtaattatagtcatattattactactaatagcagtaggacttttcctatactgtaaagcaagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15071 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut2 (opt11)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggaacttcccatcctcaagaccaacgctattacgaccatcctcgccgcagtcaccctctgcttcgcgtcatcccaaaacatcaccgaagaattttaccaatccacatgctccgcagtctcaaaaggctacctaggagccctacgcaccggatggtacacatccgtcatcacaatcgaactctccaacataaaagaaaacaaatgcaacggcaccgatgccaaagtaaaactgattaaacaagaactcgacaaatacaagaacgccgtcacagacctacagctcctcatgcaatcaactcccgccgccggcagcggatccgctatctgctcaggcatcgccgtatgcaaagtcctccacctagaaggcgaagtaaacaaaatcaagaacgcactactctcaacaaacaaagccgtcgtctccctctccaacggcgtctccgtccttaccttcaaagtcctcgaccttaagaactacattgacaaacaactcctacccatcctcaacaaacaatcctgctctatacctaatatagaaaccgtaatcgaatttcaacagaaaaacaaccgcctcctcgaaattacccgcgagttctcagtaaacgccggcgtaaccacccccgtctccacctacatgctcacaaattcagaactcctcagcctcatcaacgacatgcccataaccaacgaccaaaagaaactcatgtcaaacaacgtccaaatcgtcaggcaacaaagctacagcatcatgtgcatcattaaagaagaagtactcgcctacgtcgtgcaactacccctctacggcgtcatagacacaccctgctggaaacttcacacatcaccgctctgcaccacaaacaccaaagaaggcagtaacatatgcctcacccgaaccgaccgcggatggtactgcgacaacgccggatccgtcagcttcttcccacaagccgaaacctgcaaagtacaatccaaccgagtcttctgcgacaccatgaactctcttacgctcccctcagaagtcaacctatgcaacatcgacatcttcaaccccaaatacgactgcaaaatcatgacctccaaaacagacgtctcctcctcagtgataacctccctcggcgccattgtctcctgctacggcaaaaccaaatgcaccgcctccaacaaaaaccgtgggatcatcaaaaccttctcaaacggctgcgactacgtatccaataagggtgtcgacacagtctccgtaggcaataccctctattgcgtcaacaaacaagaaggccaatccctctacgtcaaaggcgaacctatcatcaacttctacgacccgctagtcttcccctcagacgagttcgacgcatccatctcacaagtcaacgaaaagatcaaccagtccctcgcattcatccgaaaatccgacgaacttctccacaacgttaacgtcggcaaatccaccactaacataatgatcaccacgatcatcatagtaattatcgtcatactcctcctcctaatcgctgtcggactcttcctctactgcaaggcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15072 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut2 (opt1)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15073 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut2 (opt1)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15074 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut2 (opt2)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15075 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut2 (opt3)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15076 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut2 (opt4)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15077 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut2 (opt5)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15078 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut2 (opt6)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactaccaatactcaaaacaaacgcaataacaacaattttagctgcagtaacactttgtttcgcatcctcccaaaatataacagaagaattttatcaatcaacctgctcagccgtctccaaaggatatctaggtgcactacgcactggatggtacacaagtgtcatcacaatagaactttccaacatcaaagaaaataaatgtaatggaactgacgcaaaagtaaaactcataaaacaagaactagacaaatacaaaaacgcagtaacagacctacaactattaatgcaatcaacaccagcagcaggatccggcagtgccatatgctctggaatagcagtctgcaaagttttacacttagaaggcgaagtaaacaaaatcaaaaacgccctactatctacaaataaagccgtcgtatctctctcaaatggagtatcagtactaacattcaaagtattagacttaaaaaactacatcgataaacaattattgccaatattaaacaaacaatcttgctcaataccaaatatagaaacagtcatagaatttcaacaaaaaaataaccgattattagaaataacacgagaattttcagtaaatgccggagtcaccacaccagtatcaacatacatgctaacaaattcagaactattatcattaataaacgacatgcctattacaaatgatcaaaaaaaactaatgtccaacaatgtacaaatagtccgacaacaaagctactcaatcatgtgtataataaaagaagaagtacttgcatacgtagtacaattaccactatacggagttatcgacacaccatgctggaaactccacacttcaccactctgcaccacaaacacaaaagaaggctcaaacatatgcctaacaagaacagaccgaggatggtactgcgacaacgcaggatcagtatcattcttcccacaagcagaaacttgcaaagtacaatctaacagagttttctgtgacaccatgaatagcctaacactcccctccgaagttaacctatgtaacatagatatatttaatcccaaatatgattgcaaaatcatgacatctaaaaccgacgtatcatcatctgtaatcacatcactaggtgccatagtctcatgctacggcaaaacaaaatgcaccgcctcaaacaaaaaccgaggtataataaaaaccttcagtaatggatgtgactacgtatcaaacaaaggtgttgataccgtaagcgtcggcaacaccctatactgcgtaaataaacaagaaggccaatcactatacgtcaaaggcgaaccaattattaacttctatgacccactcgtctttccctccgacgaatttgacgcaagcatatcacaagtaaacgaaaaaataaaccaatcactagcattcatacgcaaatcagatgaactactacataacgtaaacgtaggaaaatccactacaaatataatgatcacaacaataataatcgtaattatagtcatattattactactaatagcagtaggacttttcctatactgtaaagcaagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15079 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut2 (opt11)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttcccatcctcaagaccaacgctattacgaccatcctcgccgcagtcaccctctgcttcgcgtcatcccaaaacatcaccgaagaattttaccaatccacatgctccgcagtctcaaaaggctacctaggagccctacgcaccggatggtacacatccgtcatcacaatcgaactctccaacataaaagaaaacaaatgcaacggcaccgatgccaaagtaaaactgattaaacaagaactcgacaaatacaagaacgccgtcacagacctacagctcctcatgcaatcaactcccgccgccggcagcggatccgctatctgctcaggcatcgccgtatgcaaagtcctccacctagaaggcgaagtaaacaaaatcaagaacgcactactctcaacaaacaaagccgtcgtctccctctccaacggcgtctccgtccttaccttcaaagtcctcgaccttaagaactacattgacaaacaactcctacccatcctcaacaaacaatcctgctctatacctaatatagaaaccgtaatcgaatttcaacagaaaaacaaccgcctcctcgaaattacccgcgagttctcagtaaacgccggcgtaaccacccccgtctccacctacatgctcacaaattcagaactcctcagcctcatcaacgacatgcccataaccaacgaccaaaagaaactcatgtcaaacaacgtccaaatcgtcaggcaacaaagctacagcatcatgtgcatcattaaagaagaagtactcgcctacgtcgtgcaactacccctctacggcgtcatagacacaccctgctggaaacttcacacatcaccgctctgcaccacaaacaccaaagaaggcagtaacatatgcctcacccgaaccgaccgcggatggtactgcgacaacgccggatccgtcagcttcttcccacaagccgaaacctgcaaagtacaatccaaccgagtcttctgcgacaccatgaactctcttacgctcccctcagaagtcaacctatgcaacatcgacatcttcaaccccaaatacgactgcaaaatcatgacctccaaaacagacgtctcctcctcagtgataacctccctcggcgccattgtctcctgctacggcaaaaccaaatgcaccgcctccaacaaaaaccgtgggatcatcaaaaccttctcaaacggctgcgactacgtatccaataagggtgtcgacacagtctccgtaggcaataccctctattgcgtcaacaaacaagaaggccaatccctctacgtcaaaggcgaacctatcatcaacttctacgacccgctagtcttcccctcagacgagttcgacgcatccatctcacaagtcaacgaaaagatcaaccagtccctcgcattcatccgaaaatccgacgaacttctccacaacgttaacgtcggcaaatccaccactaacataatgatcaccacgatcatcatagtaattatcgtcatactcctcctcctaatcgctgtcggactcttcctctactgcaaggcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15080 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut2 (opt1)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15081 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut2 (opt1)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15082 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut2 (opt2)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15083 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut2 (opt3)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15084 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut2 (opt4)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15085 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut2 (opt5)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15086 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut2 (opt6)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactaccaatactcaaaacaaacgcaataacaacaattttagctgcagtaacactttgtttcgcatcctcccaaaatataacagaagaattttatcaatcaacctgctcagccgtctccaaaggatatctaggtgcactacgcactggatggtacacaagtgtcatcacaatagaactttccaacatcaaagaaaataaatgtaatggaactgacgcaaaagtaaaactcataaaacaagaactagacaaatacaaaaacgcagtaacagacctacaactattaatgcaatcaacaccagcagcaggatccggcagtgccatatgctctggaatagcagtctgcaaagttttacacttagaaggcgaagtaaacaaaatcaaaaacgccctactatctacaaataaagccgtcgtatctctctcaaatggagtatcagtactaacattcaaagtattagacttaaaaaactacatcgataaacaattattgccaatattaaacaaacaatcttgctcaataccaaatatagaaacagtcatagaatttcaacaaaaaaataaccgattattagaaataacacgagaattttcagtaaatgccggagtcaccacaccagtatcaacatacatgctaacaaattcagaactattatcattaataaacgacatgcctattacaaatgatcaaaaaaaactaatgtccaacaatgtacaaatagtccgacaacaaagctactcaatcatgtgtataataaaagaagaagtacttgcatacgtagtacaattaccactatacggagttatcgacacaccatgctggaaactccacacttcaccactctgcaccacaaacacaaaagaaggctcaaacatatgcctaacaagaacagaccgaggatggtactgcgacaacgcaggatcagtatcattcttcccacaagcagaaacttgcaaagtacaatctaacagagttttctgtgacaccatgaatagcctaacactcccctccgaagttaacctatgtaacatagatatatttaatcccaaatatgattgcaaaatcatgacatctaaaaccgacgtatcatcatctgtaatcacatcactaggtgccatagtctcatgctacggcaaaacaaaatgcaccgcctcaaacaaaaaccgaggtataataaaaaccttcagtaatggatgtgactacgtatcaaacaaaggtgttgataccgtaagcgtcggcaacaccctatactgcgtaaataaacaagaaggccaatcactatacgtcaaaggcgaaccaattattaacttctatgacccactcgtctttccctccgacgaatttgacgcaagcatatcacaagtaaacgaaaaaataaaccaatcactagcattcatacgcaaatcagatgaactactacataacgtaaacgtaggaaaatccactacaaatataatgatcacaacaataataatcgtaattatagtcatattattactactaatagcagtaggacttttcctatactgtaaagcaagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15087 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut2 (opt11)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttcccatcctcaagaccaacgctattacgaccatcctcgccgcagtcaccctctgcttcgcgtcatcccaaaacatcaccgaagaattttaccaatccacatgctccgcagtctcaaaaggctacctaggagccctacgcaccggatggtacacatccgtcatcacaatcgaactctccaacataaaagaaaacaaatgcaacggcaccgatgccaaagtaaaactgattaaacaagaactcgacaaatacaagaacgccgtcacagacctacagctcctcatgcaatcaactcccgccgccggcagcggatccgctatctgctcaggcatcgccgtatgcaaagtcctccacctagaaggcgaagtaaacaaaatcaagaacgcactactctcaacaaacaaagccgtcgtctccctctccaacggcgtctccgtccttaccttcaaagtcctcgaccttaagaactacattgacaaacaactcctacccatcctcaacaaacaatcctgctctatacctaatatagaaaccgtaatcgaatttcaacagaaaaacaaccgcctcctcgaaattacccgcgagttctcagtaaacgccggcgtaaccacccccgtctccacctacatgctcacaaattcagaactcctcagcctcatcaacgacatgcccataaccaacgaccaaaagaaactcatgtcaaacaacgtccaaatcgtcaggcaacaaagctacagcatcatgtgcatcattaaagaagaagtactcgcctacgtcgtgcaactacccctctacggcgtcatagacacaccctgctggaaacttcacacatcaccgctctgcaccacaaacaccaaagaaggcagtaacatatgcctcacccgaaccgaccgcggatggtactgcgacaacgccggatccgtcagcttcttcccacaagccgaaacctgcaaagtacaatccaaccgagtcttctgcgacaccatgaactctcttacgctcccctcagaagtcaacctatgcaacatcgacatcttcaaccccaaatacgactgcaaaatcatgacctccaaaacagacgtctcctcctcagtgataacctccctcggcgccattgtctcctgctacggcaaaaccaaatgcaccgcctccaacaaaaaccgtgggatcatcaaaaccttctcaaacggctgcgactacgtatccaataagggtgtcgacacagtctccgtaggcaataccctctattgcgtcaacaaacaagaaggccaatccctctacgtcaaaggcgaacctatcatcaacttctacgacccgctagtcttcccctcagacgagttcgacgcatccatctcacaagtcaacgaaaagatcaaccagtccctcgcattcatccgaaaatccgacgaacttctccacaacgttaacgtcggcaaatccaccactaacataatgatcaccacgatcatcatagtaattatcgtcatactcctcctcctaatcgctgtcggactcttcctctactgcaaggcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15088 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut2 (opt1)
  source 1..1813: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15089 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut2 (opt1)
  source 1..1813: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15090 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut2 (opt2)
  source 1..1813: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15091 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut2 (opt3)
  source 1..1813: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15092 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut2 (opt4)
  source 1..1813: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15093 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut2 (opt5)
  source 1..1813: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15094 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut2 (opt6)
  source 1..1813: mol_type = other RNA
gggagactttcccattctgtagcagaatttggtgttgcctgtggtcttggtcccgcggagaagcttaccatggaactaccaatactcaaaacaaacgcaataacaacaattttagctgcagtaacactttgtttcgcatcctcccaaaatataacagaagaattttatcaatcaacctgctcagccgtctccaaaggatatctaggtgcactacgcactggatggtacacaagtgtcatcacaatagaactttccaacatcaaagaaaataaatgtaatggaactgacgcaaaagtaaaactcataaaacaagaactagacaaatacaaaaacgcagtaacagacctacaactattaatgcaatcaacaccagcagcaggatccggcagtgccatatgctctggaatagcagtctgcaaagttttacacttagaaggcgaagtaaacaaaatcaaaaacgccctactatctacaaataaagccgtcgtatctctctcaaatggagtatcagtactaacattcaaagtattagacttaaaaaactacatcgataaacaattattgccaatattaaacaaacaatcttgctcaataccaaatatagaaacagtcatagaatttcaacaaaaaaataaccgattattagaaataacacgagaattttcagtaaatgccggagtcaccacaccagtatcaacatacatgctaacaaattcagaactattatcattaataaacgacatgcctattacaaatgatcaaaaaaaactaatgtccaacaatgtacaaatagtccgacaacaaagctactcaatcatgtgtataataaaagaagaagtacttgcatacgtagtacaattaccactatacggagttatcgacacaccatgctggaaactccacacttcaccactctgcaccacaaacacaaaagaaggctcaaacatatgcctaacaagaacagaccgaggatggtactgcgacaacgcaggatcagtatcattcttcccacaagcagaaacttgcaaagtacaatctaacagagttttctgtgacaccatgaatagcctaacactcccctccgaagttaacctatgtaacatagatatatttaatcccaaatatgattgcaaaatcatgacatctaaaaccgacgtatcatcatctgtaatcacatcactaggtgccatagtctcatgctacggcaaaacaaaatgcaccgcctcaaacaaaaaccgaggtataataaaaaccttcagtaatggatgtgactacgtatcaaacaaaggtgttgataccgtaagcgtcggcaacaccctatactgcgtaaataaacaagaaggccaatcactatacgtcaaaggcgaaccaattattaacttctatgacccactcgtctttccctccgacgaatttgacgcaagcatatcacaagtaaacgaaaaaataaaccaatcactagcattcatacgcaaatcagatgaactactacataacgtaaacgtaggaaaatccactacaaatataatgatcacaacaataataatcgtaattatagtcatattattactactaatagcagtaggacttttcctatactgtaaagcaagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15095 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut2 (opt11)
  source 1..1813: mol_type = other RNA
gggagactttcccattctgtagcagaatttggtgttgcctgtggtcttggtcccgcggagaagcttaccatggaacttcccatcctcaagaccaacgctattacgaccatcctcgccgcagtcaccctctgcttcgcgtcatcccaaaacatcaccgaagaattttaccaatccacatgctccgcagtctcaaaaggctacctaggagccctacgcaccggatggtacacatccgtcatcacaatcgaactctccaacataaaagaaaacaaatgcaacggcaccgatgccaaagtaaaactgattaaacaagaactcgacaaatacaagaacgccgtcacagacctacagctcctcatgcaatcaactcccgccgccggcagcggatccgctatctgctcaggcatcgccgtatgcaaagtcctccacctagaaggcgaagtaaacaaaatcaagaacgcactactctcaacaaacaaagccgtcgtctccctctccaacggcgtctccgtccttaccttcaaagtcctcgaccttaagaactacattgacaaacaactcctacccatcctcaacaaacaatcctgctctatacctaatatagaaaccgtaatcgaatttcaacagaaaaacaaccgcctcctcgaaattacccgcgagttctcagtaaacgccggcgtaaccacccccgtctccacctacatgctcacaaattcagaactcctcagcctcatcaacgacatgcccataaccaacgaccaaaagaaactcatgtcaaacaacgtccaaatcgtcaggcaacaaagctacagcatcatgtgcatcattaaagaagaagtactcgcctacgtcgtgcaactacccctctacggcgtcatagacacaccctgctggaaacttcacacatcaccgctctgcaccacaaacaccaaagaaggcagtaacatatgcctcacccgaaccgaccgcggatggtactgcgacaacgccggatccgtcagcttcttcccacaagccgaaacctgcaaagtacaatccaaccgagtcttctgcgacaccatgaactctcttacgctcccctcagaagtcaacctatgcaacatcgacatcttcaaccccaaatacgactgcaaaatcatgacctccaaaacagacgtctcctcctcagtgataacctccctcggcgccattgtctcctgctacggcaaaaccaaatgcaccgcctccaacaaaaaccgtgggatcatcaaaaccttctcaaacggctgcgactacgtatccaataagggtgtcgacacagtctccgtaggcaataccctctattgcgtcaacaaacaagaaggccaatccctctacgtcaaaggcgaacctatcatcaacttctacgacccgctagtcttcccctcagacgagttcgacgcatccatctcacaagtcaacgaaaagatcaaccagtccctcgcattcatccgaaaatccgacgaacttctccacaacgttaacgtcggcaaatccaccactaacataatgatcaccacgatcatcatagtaattatcgtcatactcctcctcctaatcgctgtcggactcttcctctactgcaaggcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15096 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut2 (opt1)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15097 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut2 (opt1)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15098 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut2 (opt2)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15099 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut2 (opt3)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15100 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut2 (opt4)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15101 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut2 (opt5)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15102 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut2 (opt6)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactaccaatactcaaaacaaacgcaataacaacaattttagctgcagtaacactttgtttcgcatcctcccaaaatataacagaagaattttatcaatcaacctgctcagccgtctccaaaggatatctaggtgcactacgcactggatggtacacaagtgtcatcacaatagaactttccaacatcaaagaaaataaatgtaatggaactgacgcaaaagtaaaactcataaaacaagaactagacaaatacaaaaacgcagtaacagacctacaactattaatgcaatcaacaccagcagcaggatccggcagtgccatatgctctggaatagcagtctgcaaagttttacacttagaaggcgaagtaaacaaaatcaaaaacgccctactatctacaaataaagccgtcgtatctctctcaaatggagtatcagtactaacattcaaagtattagacttaaaaaactacatcgataaacaattattgccaatattaaacaaacaatcttgctcaataccaaatatagaaacagtcatagaatttcaacaaaaaaataaccgattattagaaataacacgagaattttcagtaaatgccggagtcaccacaccagtatcaacatacatgctaacaaattcagaactattatcattaataaacgacatgcctattacaaatgatcaaaaaaaactaatgtccaacaatgtacaaatagtccgacaacaaagctactcaatcatgtgtataataaaagaagaagtacttgcatacgtagtacaattaccactatacggagttatcgacacaccatgctggaaactccacacttcaccactctgcaccacaaacacaaaagaaggctcaaacatatgcctaacaagaacagaccgaggatggtactgcgacaacgcaggatcagtatcattcttcccacaagcagaaacttgcaaagtacaatctaacagagttttctgtgacaccatgaatagcctaacactcccctccgaagttaacctatgtaacatagatatatttaatcccaaatatgattgcaaaatcatgacatctaaaaccgacgtatcatcatctgtaatcacatcactaggtgccatagtctcatgctacggcaaaacaaaatgcaccgcctcaaacaaaaaccgaggtataataaaaaccttcagtaatggatgtgactacgtatcaaacaaaggtgttgataccgtaagcgtcggcaacaccctatactgcgtaaataaacaagaaggccaatcactatacgtcaaaggcgaaccaattattaacttctatgacccactcgtctttccctccgacgaatttgacgcaagcatatcacaagtaaacgaaaaaataaaccaatcactagcattcatacgcaaatcagatgaactactacataacgtaaacgtaggaaaatccactacaaatataatgatcacaacaataataatcgtaattatagtcatattattactactaatagcagtaggacttttcctatactgtaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15103 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut2 (opt11)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaacttcccatcctcaagaccaacgctattacgaccatcctcgccgcagtcaccctctgcttcgcgtcatcccaaaacatcaccgaagaattttaccaatccacatgctccgcagtctcaaaaggctacctaggagccctacgcaccggatggtacacatccgtcatcacaatcgaactctccaacataaaagaaaacaaatgcaacggcaccgatgccaaagtaaaactgattaaacaagaactcgacaaatacaagaacgccgtcacagacctacagctcctcatgcaatcaactcccgccgccggcagcggatccgctatctgctcaggcatcgccgtatgcaaagtcctccacctagaaggcgaagtaaacaaaatcaagaacgcactactctcaacaaacaaagccgtcgtctccctctccaacggcgtctccgtccttaccttcaaagtcctcgaccttaagaactacattgacaaacaactcctacccatcctcaacaaacaatcctgctctatacctaatatagaaaccgtaatcgaatttcaacagaaaaacaaccgcctcctcgaaattacccgcgagttctcagtaaacgccggcgtaaccacccccgtctccacctacatgctcacaaattcagaactcctcagcctcatcaacgacatgcccataaccaacgaccaaaagaaactcatgtcaaacaacgtccaaatcgtcaggcaacaaagctacagcatcatgtgcatcattaaagaagaagtactcgcctacgtcgtgcaactacccctctacggcgtcatagacacaccctgctggaaacttcacacatcaccgctctgcaccacaaacaccaaagaaggcagtaacatatgcctcacccgaaccgaccgcggatggtactgcgacaacgccggatccgtcagcttcttcccacaagccgaaacctgcaaagtacaatccaaccgagtcttctgcgacaccatgaactctcttacgctcccctcagaagtcaacctatgcaacatcgacatcttcaaccccaaatacgactgcaaaatcatgacctccaaaacagacgtctcctcctcagtgataacctccctcggcgccattgtctcctgctacggcaaaaccaaatgcaccgcctccaacaaaaaccgtgggatcatcaaaaccttctcaaacggctgcgactacgtatccaataagggtgtcgacacagtctccgtaggcaataccctctattgcgtcaacaaacaagaaggccaatccctctacgtcaaaggcgaacctatcatcaacttctacgacccgctagtcttcccctcagacgagttcgacgcatccatctcacaagtcaacgaaaagatcaaccagtccctcgcattcatccgaaaatccgacgaacttctccacaacgttaacgtcggcaaatccaccactaacataatgatcaccacgatcatcatagtaattatcgtcatactcctcctcctaatcgctgtcggactcttcctctactgcaaggcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15104 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut2 (opt1)
  source 1..1814: mol_type = other RNA
gggagagcctctgctggagtccggggagtggcgttggctgctagagcgaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15105 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut2 (opt1)
  source 1..1814: mol_type = other RNA
gggagagcctctgctggagtccggggagtggcgttggctgctagagcgaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15106 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut2 (opt2)
  source 1..1814: mol_type = other RNA
gggagagcctctgctggagtccggggagtggcgttggctgctagagcgaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt
